United States Patent 12,577,609 (METHODS FOR CELL-TYPE SPECIFIC PROFILING TO IDENTIFY DRUG TARGETS) - sequence listing, part 14

SEQ ID NO: 18554 - DNA, 2344 bp, Homo sapiens
  ENST00000513416
aatctgtatgacaaacctgtacatgtacccctaaagttgaaacagaagttaaaaacaaaacacaaaaaacatgatcctgagttctttcaatggcaacaatccagtttaattggtcaagttctaatggtaagtaccacatcgtttattgcttgtttcttaatctggccacctgctcggcttgtgatggagggtgtgcattctccaggcagtgtaatagtacccatcctttatgaagcatgtctttggtcgggccctctaactgtgtttattttattggatccgtacagcccaataagacaggtcttacctctaaggatcaagaacaaggtgtcagaggaagaggtaggaaaatataccatagtgggaatctgtgccaagaggagtcatgagaagaggtttctgcaccagcctaggaaagttgagatgagtgcccttaggtgatcccgtgcaagggaggcaccgccttgggttgtcagtcattggaagccgccctagccacagaaatattttgtcagatttccaacagggctatggcaactgagggcatagtctgtaggcaatggacatggtattcgactcagtattcttgtttcgtttatgatacaagggcacgttttccagtaagttctattctgagagagtgagcgagaaaggacggatctcccggttgactggcttcggagcagatgggacacagcagcttctgaaagcctcctggttctcctgcaaataaatttctcagatgcatatatttagggaaacaattcatcaatgaagatgacaaaaccatctggctctagagacttaaaaaaaattttagaggttgtaaacatttacattctgatgaagagtgtgtgtctaggttttatttcaaggatttgatgagtttggtttgtggcttgtttttagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattg

SEQ ID NO: 18555 - DNA, 739 bp, Homo sapiens
  ENST00000512286
agtcctgagtcgtgccaccaaagttggctgacacgtcaagatgccctgggctttgtctgcaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcg

SEQ ID NO: 18556 - DNA, 3500 bp, Homo sapiens
  ENST00000502949
cacactcgccctgcgccctgcgggaatggcgccccggccaaaaaagcaaccagacaaaaacccattgcacgggcgggaactggtctgtgcgacccgcaaaagggaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaa

SEQ ID NO: 18557 - DNA, 1326 bp, Homo sapiens
  ENST00000510448
tgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagaattctgcctctgtgtgcctgaaaacacagcgccaaagctcctggcagcatgaagtcttccctttcatttcagtcaagcaatcagatgtgtaagaggataaacaaacactcgtaatgaataaaaatcctcggccacacggactcagagggagggactgagcaggaatcgtaaagtgggcatttagctgagcatggtttccactaatcattgttatttttctgagccagtatagaatagttaaggacaagggagccctgcttgcttctgtttgggcttagagtccaggcttggctactcattagctgtatgactcatggcaagttatttaaccttcctgatccccaaatttctcatcaatacaatgaggttatgagagtagctacttcctaggaacataaaatgaaaaaaatattaagtgaaaaaaaatgcacgtaagatacttaccaaaatgacggctgtagttaaacgttagctgttatatttatctggcatataaaaccttctcaataaatgttagctcttacatttactcctctattagaccataagctgagtaagaggaaggccccagtcgtgtcatttgtgataactcatgcatagtaggtactcacacccacagacgactccggtctctcaagagacaagaaaactgattttttaccatctcggacggctacaaaagggtataataactcatgaaggcaaacagagacatttacaaatgggtagattaggactggacatggcattggagcatttgcgtagctgttatttctgtagcagataatggaaagtgaaaggggtgcacgtcagcgtctcttccacggtgagaaggaagtcactgttgcaagaagctaatgcgaaatcatttctctctgatttacctgaggaggttaacaaggacccatcaaaaccttccaggcttgatgccccatagtctgctggttaataaacttcactcatgcaaattctgtcccatccttaaa

SEQ ID NO: 18558 - DNA, 429 bp, Homo sapiens
  ENST00000507618
acaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaagatctactttctgggaacctttctgctatccatattgatcgcctggactgtgcagtatttccagtctgtctcag

SEQ ID NO: 18559 - DNA, 560 bp, Homo sapiens
  ENST00000509290
tagagaacaaagcaaaatagggaaagctaataataagtcagtaaacatgacttaatagagtactagaactcttggtagagattatattttttcatattggtggatatatttcattatgtatcttacatgtctttgtttccataaaagacaactcctaatcattcataagaaagggcactaaatgaaaagctctcagaatgcattttctttaccttaacattcagttctggtttgttgctctataaaaattctaactagcaaaatattccccaagtgggatttattgagagcatatgaagaaaaacattttattaaatttgccatggtttgcgtattttctcttcccttttttttttcagatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgt

SEQ ID NO: 18560 - DNA, 404 bp, Homo sapiens
  ENST00000514321
actttagctggtgaatatttccataaggctgcgcaaggtggacacatggaagggaccttgtggtgttctctctactatatcacaggcaacctggagacattccctagagatcctgagaaagctgttgtaaaaagtttgtcgacctctgttttaggccaccctcacactgataccctggctctccaaaagattgttcttcataacacatttgggttcaaattcaacctgacctgaccttggtgataaacttgacttagactgacttgaagttttttatcattgttatttagtatatttgacatgaatattcatgttttgtggattttctgttatcctcttgttaatgatttctagcttaatttcactgtgatcagagaatatattctgaatgattccaatccttt

SEQ ID NO: 18561 - DNA, 611 bp, Homo sapiens
  ENST00000513364
agtggcggcggcggcgggtccggaggtggcggcaggtggccccgcgcgcggcggccggcccggccgggggcgggcgggaaggtggcgcctcgggcgggggccggtccctgcaccaggtgacctgttccggcccggatccgggcggcctcgccatgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctg

SEQ ID NO: 18562 - DNA, 553 bp, Homo sapiens
  ENST00000510880
ttgcaaaggacacaaaaggccgacttaaaagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttat

SEQ ID NO: 18563 - DNA, 605 bp, Homo sapiens
  ENST00000513691
ggtggcggcggcaccacacaaaaccctcgggaaacatccagaacgtgccgcgaaccagccggcagggtggggcgcagcccggctgcaaacatgccagcaaggaggcagtcccaaccccgcagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttc

SEQ ID NO: 18564 - DNA, 558 bp, Homo sapiens
  ENST00000514872
aaagagcgcagtggtggcggtggcggcggcaccacacaaaaccctcgggaaacatccagaacgtgccgcgaaccagccggcagggtggggcgcagcccggctgcaaacatgccagcaaggaggcagtcccaaccccgcaggtggacaggtggagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaa

SEQ ID NO: 18565 - DNA, 1633 bp, Homo sapiens
  ENST00000495461
aagtcgcagatgtgacgatgcaaaaacgcccgtcgggggcgcgtctctttcagcagccaatgggctctgcccaccttcgtcctcgtcagcattttgtctaatcgcggcctgtgacgctcgaagggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataa

SEQ ID NO: 18566 - DNA, 611 bp, Homo sapiens
  ENST00000488746
ggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatag

SEQ ID NO: 18567 - DNA, 574 bp, Homo sapiens
  ENST00000487571
agagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgttgtaagtatagaagagctcttaattgccctgatatttaagttgacaggtatacatcatgtgcattatgttagggatcttaaataagctcaactttcctgaaacagttttctattgcaatttaaaaaatagctttacacagggaaatagatgttagtgataaagttgctaccaccagatagcttatgattatgagtatatgttagttggattggtaaacttgaccacatcttaaccttggtggtaactacttcaacctatggctgggtccgtcaattctgatgctaaatgactggacctcactttctctctactattcttgttttgtttttttctttgtgcatgcaactttcattccatattatataacaagtaaataaaaggttttatatcctggttt

SEQ ID NO: 18568 - DNA, 340 bp, Homo sapiens
  ENST00000485414
gcggcctgtgacgctcgaagggcggggagcagagggagatacagaaaccgacaggggccaggcgcccggtggctccgaagcggggaagtgggacaagatggtttacatctcgaacggagcaagttaattattaccggaatggagaatccgagagacttaattctgcgaacccacaaagaagatgaccggaaaggaaggacatgactgtgtcagatcagtgctagagctgcctgcccacctgtttgactcaggacaagtgttggacagccggagtcagtctccatggagattatctttgataacagatttcttctggggaatagctgagtttgtggttttg

SEQ ID NO: 18569 - DNA, 814 bp, Homo sapiens
  ENST00000541726
cgcccgtcgggggcgcgtctctttcagcagccaatgggctctgcccaccttcgtcctcgtcagcattttgtctaatcgcggcctgtgacgctcgaagggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagc

SEQ ID NO: 18570 - DNA, 1054 bp, Homo sapiens
  ENST00000402395
ggaagaaaccgaggcccagggattacacagccagtagagagaggacagagcatggagctcctggagaggcagtggataattcttcccgacagaggagctgactgttgaaccccttctttgaaggagagtccgtgctgccaaatcgaagaagagaaacgccctggctggaaagcagagagaacagcagtcgcaggttcggctcagaaactccagtgtccctcagcgtctcgccggcaccctctgccggcgtgaggtggcgctgcctggccgcatcctgggggagcgtccacatcctcggtcgacaaaaggagcgtcgacactctcggacctgggaaagtgacggcccaaacgccagggaggagccaggacctcgccctgagctagcgggagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaactgag

SEQ ID NO: 18571 - DNA, 2070 bp, Homo sapiens
  ENST00000490967
cttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagaggtgagtacgccggcctccagccccggcactatcgttccccaaccctgcggccccatgggagcaccgtccgtcccggccccaagaccacctcgaaccgcgagtctccctgctttccccctggcgccgggaccatccctcctgttccctagccccagatggccccagcatccaccgtggaagcctgagacaccgactttggggcctggaactccgaacccttccccagctccccctacccggtccgacagcggacacccagacacactgacgcagtctcctaactcttctcgtggcctatgactcccaatcctgtcccaacttcccatcccccatcacttcatgttttcctggaattcccccccgacccggttccagggctggaggctccagaaagtctcttttccttctcctggggggaaagaagactttctgggtgcctcctcccatatgcaggatccggggaagggggccaactcggaggggcaaccgagttgggaacttggttgccaacatttactctgcagcagcctcccatcctcccccaaccaggaaattcccgttcggagtccctgtcttgctatgtgactttgaccatcacagcccgcctctgagctttttgtcagctctgtctgacaaaagggtgtagaatggttgggtgccggtggtgcacgcctgtaatcccagcactttgggaggccaaggcaggaggattgcttgagcccaggagttcaagaccagcttgggggacatagtgagaccctgtctctaagaaaagggctgagggtaggatggaggagggctggagtgggtggtcctggggtctagactcctgctggatggtggcatctcctcagggaaggcagggaggagccctcccatcctcccatgtcagggaagcaaccacatggtctgtggggctgggccgcaggtggcaggcagggtgaggtctgcctgtgtagagtagggaccagatggtaggtgtctccaatgggggcccccagggccattctgaggtgtttccttctgctctgcctccactgtgagatttcagggatcaaaggccaagcccaggtctctactgcttaagaggagcagggtgatcatttcccctgggcattgggagtcagtccacagccagtaggatgtacaggccccaaggctggcaggcacactgtgggtctctggccttgctcttttcccctggtgtctctaggcctgagtctccccacctgtatacacagttcccccttctgcccacaagggtccagcatttccttcagaccttgggaactgctgatccggggataactcacagcccgacccaactcagggataaggaagtatggctttggggatgtgactggaataaacgtgaaggactcctgacctatcccattttatccccctccagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 18572 - DNA, 694 bp, Homo sapiens
  ENST00000400299
agacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 18573 - DNA, 703 bp, Homo sapiens
  ENST00000465536
gcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagaggcctgagtctccccacctgtatacacagttcccccttctgcccacaagggtccagcatttccttcagaccttgggaactgctgatccggggataactcacagcccgacccaactcagggataaggaagtatggctttggggatgtgactggaataaacgtgaaggactcctgacctatcccattttatccccctccagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctg

SEQ ID NO: 18574 - DNA, 605 bp, Homo sapiens
  ENST00000491958
actcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagggtccagcatttccttcagaccttgggaactgctgatccggggataactcacagcccgacccaactcagggataaggaagtatggctttggggatgtgactggaataaacgtgaaggactcctgacctatcccattttatccccctccagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagccccc

SEQ ID NO: 18575 - DNA, 673 bp, Homo sapiens
  ENST00000495533
tgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattggtagtggctcccagaggattctgaggtggtctccatgttgggtgggcaagagagattgactagtgatgactgccacagaatggagaggagggccctttacttctttgaaccctaattttctcacgtataagcggagaccctggcccctcccgggcacagagtaagctctgagcaaaggaggcaatgctgttcccatcagtaaggctgcggaaaccaccacctccctctgcccaccaccccgctccttaacaccacctccagtcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcc

SEQ ID NO: 18576 - DNA, 500 bp, Homo sapiens
  ENST00000460642
gcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagggataaggaagtatggctttggggatgtgactggaataaacgtgaaggactcctgacctatcccattttatccccctccagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagta

SEQ ID NO: 18577 - DNA, 334 bp, Homo sapiens
  ENST00000469262
ctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagaggtgaggccgtgggaggtgggctgggggcgaggccagaggcgaggcccagcctgctgaccccgcccctcctccgcctcagcgcatcccactcagt

SEQ ID NO: 18578 - DNA, 707 bp, Homo sapiens
  ENST00000465447
gcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgagtttgaaggaagaggtccctagctctgttccccctgagcctcttggggagtgggcaacatggtcccaatgactggggcggggaggggggaaggatccctaggctgagagtctagcctaggctgagagtctagcctgcacctgacttgctttatgacctcactgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattggtagtggctcccagaggattctgaggtggtctccatgttgggtgggcaagagagattgactagtgatgactgccacagaatggagaggagggccctttacttctttgaa

SEQ ID NO: 18579 - DNA, 689 bp, Homo sapiens
  ENST00000611680
agacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgcctt

SEQ ID NO: 18580 - DNA, 2256 bp, Homo sapiens
  ENST00000550948
aaacaatggggtgtgggctgtcacatggccctgcctaagtaaccacattctcgcttcctccttccacacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaa

SEQ ID NO: 18581 - DNA, 1704 bp, Homo sapiens
  ENST00000228463
aatcatccgagaaccttggagggtggacagtgccccttttacagatgagaaaactgaggcttgaaggggagaagcagctgcctctggcggcatggcttctggctgcaggatgcccatggagttcgtggtgaccctaggcctgtgtctcggcttcctttgctgaacttgaacaggaagatggcagtgggggccagtggtctagaaggagataagatggctggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccg

SEQ ID NO: 18582 - DNA, 1613 bp, Homo sapiens
  ENST00000388962
cccattgtctcctcctaggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaagg

SEQ ID NO: 18583 - DNA, 934 bp, Homo sapiens
  ENST00000621029
aaactttacggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagcca

SEQ ID NO: 18584 - DNA, 3158 bp, Homo sapiens
  ENST00000619119
gtgggtggcacattgtgaattaatgtctgtgagtgtgtatacaagagaggagattactgggaagggtgacgtggtgaggcgggcttgccagtgcagggtgaccctgagggtgtgcccagtggcgtgggtgtgtctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccgtgagtgcgggagtgggtatggggttggggaggggggcagcggcgcagactccgggagcccccgccgcagcggggctgtgcgccctaccccagctaggccccttccccgcagaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcc

SEQ ID NO: 18585 - DNA, 2958 bp, Homo sapiens
  ENST00000616701
tctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaaccccagtcctcggc

SEQ ID NO: 18586 - DNA, 1061 bp, Homo sapiens
  ENST00000612509
tggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaaggtgccagggactcccaaccccagcactccccagggaaggagccctgggaccccactccagcctggagagacccagaggaatggctccctgagactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccgtgagtgcgggagtgggtatggggttggggaggg

SEQ ID NO: 18587 - DNA, 2755 bp, Homo sapiens
  ENST00000433753
gcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaa

SEQ ID NO: 18588 - DNA, 2292 bp, Homo sapiens
  ENST00000611067
gaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccgccccttccccgcagaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtga

SEQ ID NO: 18589 - DNA, 2710 bp, Homo sapiens
  ENST00000441915
gctaaaacagaggcctgcctgttctggctgggatgagggcagggaggtcgaggtggctgaggtctgggggtggtgagtcagggtgggggctcgtgtaattcttctggggtgcctctgagtcatgggaggctttgcaggcctgtgcttccccagacacccaccctcgtgaggcctgggctggtcagcaagggcccccaggtccctgtagcccatgttagtacttgcctgggctgatgccgaagagagggaggggtgaggatgccactggtgagctgggacctcttaaggctacgtccctgggggaagcctcacacctccaaccctactagactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaacccca

SEQ ID NO: 18590 - DNA, 2221 bp, Homo sapiens
  ENST00000456560
ctgatcctttggattcggtccgcgcagagcgccaactggacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaa

SEQ ID NO: 18591 - DNA, 594 bp, Homo sapiens
  ENST00000439487
gattcggtccgcgcagagcgccaactggacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctcctgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcg

SEQ ID NO: 18592 - DNA, 1011 bp, Homo sapiens
  ENST00000434030
aactggacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccgtgagtgcgggagtgggtatggggttggggaggggggcagcggcgcagactccgggagcccccgccgcagcggggctgtgcgccctaccccagctaggccccttccccgcagaggatgtgtttctgttgtcctcgcgggaccaccggaccccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatggttcgtagcccagggacttctgctacaacccacttcaaagcctcaagggtttgagaacttggcctggggtcttcttggtgaatgtggtttcttcctttagttatgggtgggaaaacgtttccatcataagacaaggcttgtttcccgcctctgacttcctagggcaaggctgatctcctctctaattctcagggcagggttctgtccccatccccctccatgttcccagaggctgggcatggagggctgcctatcaagcccccatatctatatccctgctgtg

SEQ ID NO: 18593 - DNA, 2065 bp, Homo sapiens
  ENST00000456210
gacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaagaacgacgtgggcggccagcgcagcctggtcaacaagtggacgacgttcctgaaggcgcggctggtgtgctcggtgcccggcgtcgagggcgacacccacttcgatcagctcctgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagagggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaaccccagtcctcggccttgctatgtggtcttgggcaccttactagcggtgtcagggcccgagtttctcctgtccaaggttgcctggtgaggattaaaggtggttccggccaggcgcggtggctcacgcctgtaatcccaacactttcggaggcccaggcggacggatcacgaggtcaggagatggaaaccatcccggctaacacggtgaaaccccgtctgtactaaaaatacaaaaaattagtcgggcgtggtggcgggcgcctgtaatcctagctactcaggaggctgaggcaggagaattgcttgaacctgggaggtggaggttgcaatgagcctagatctcgccgctgcactccagcctgggcgacagagcgagactcc

SEQ ID NO: 18594 - DNA, 1765 bp, Homo sapiens
  ENST00000418576
atggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaagaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttatta

SEQ ID NO: 18595 - DNA, 3283 bp, Homo sapiens
  ENST00000419007
acgacgacaaaatctacttcttctttcgtgagacggcggtagaggcggcgccggcactgggacgcctgtccgtgtcccgcgttggccagatctgccgggtgaggagtccctgggccacacccggcgaccctgcccctacccctttgcctgccctggtctcgccctcatcccctttgatcgtcccggcagaacgacgtgggcggccagcgcagcctggtcaacaagtggacgacgttcctgaaggcgcggctggtgtgctcggtgcccggcgtcgagggcgacacccacttcgatcagctccgtgagtgcgggagtgggtatggggttggggaggggggcagcggcgcagactccgggagcccccgccgcagcggggctgtgcgccctaccccagctaggccccttccccgcagaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatggttcgtagcccagggacttctgctacaacccacttcaaagcctcaagggtttgagaacttggcctggggtcttcttggtgaatgtggtttcttcctttagttatgggtgggaaaacgtttccatcataagacaaggcttgtttcccgcctctgacttcctagggcaaggctgatctcctctctaattctcagggcagggttctgtccccatccccctccatgttcccagaggctgggcatggagggctgcctatcaagcccccatatctatatccctgctgtgcctccctttcccccacccccagtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggtgaggcctcacccccagtcgcccgggacccccccaccccactaagccctgaccccgtcgcccctcctccctctcaggactcggccgctgtcaccagcatgcaaatttcttccaagagggtgagtgaccaggatgggggtcggggtgggatggactgagcttgtgcctggcgcgtcccaagcctctggccccttttggtagtttgcagtcccgggtttgagtacaggctctggctttgttagactgtgtgacctgaggcgtaagacctcagtgttcccatctgtcgagtggaagaagggatccctgaccgatgggaggcaggcgtggggtcgccctcggtcagcccagagcccctcgtgccccctagcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgagccttactccgccctccccgccaggctcctgtcccaccccctgcatccaggagaggccccgccctacccaacgaagccccgtccaaccagacccactccccgccctgtccagtttggtccctcacctgcactccacaagctgctgaggccccattgcgtccaacggggctcccgacccgcctcccctgaatcaaggagaagacccgccctcgaccctcccattaaggtccctgaccaccccccaccaagttcatgtaaaccccgcctctttcggattctcccttgaagaccaccagctcccaaacactcagccttaaaatgtgcgcctgcgggcacccctttcccgctccacctcggctcccaatgactctttgcttcttccgtcgcgtgctagggcccggaagccctgttcccggcccgacacccccgcctcacgctgccctctgcccgcaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcag

SEQ ID NO: 18596 - DNA, 1088 bp, Homo sapiens
  ENST00000416295
tgctgatggaagctctccctgttcagtcccatctccacatcctttcctgggctgtgtctccaccctgtggatgctgcccaacccacactcttccagtccacactcttcacaacccaaacatgctgagggtagacgcctcaaaggcgaggagacactagccccagctgtccgggagcaccaatggtcattaccccttctcatccctgcagacgttggcacggtgctgaaggtgatctcggtccccaagggcagtaggcccagcgcagaggggctgctcctggaggagctgcacgtgtttgaggactcggccgctgtcaccagcatgcaaatttcttccaagagggtgagtgaccaggatgggggtcggggtgggatggactgagcttgtgcctggcgcgtcccaagcctctggccccttttggtagtttgcagtcccgggtttgagtacaggctctggctttgttagactgtgtgacctgaggcgtaagacctcagtgttcccatctgtcgagtggaagaagggatccctgaccgatgggaggcaggcgtggggtcgccctcggtcagcccagagcccctcgtgccccctagcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgtt

SEQ ID NO: 18597 - DNA, 2925 bp, Homo sapiens
  ENST00000618865
gggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcc

SEQ ID NO: 18598 - DNA, 5174 bp, Homo sapiens
  ENST00000265361
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtccagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacagcatttaaagttgtataaaaacatgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttattttagactcaaagaatataatctggcactactcagttattactgtttgttctcttattccctagtctgtgtggcaaattaaacaatataagaaggaaaaatttgaagtattagacttctaaataaggtgtgaaatcatcaaaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattcccca

SEQ ID NO: 18599 - DNA, 2415 bp, Homo sapiens
  ENST00000419255
acagttcaggaaacttaaaaggatggcatatggaagttgagtgaaggagaaagagagggaagtagaaaagaggagaaaaatgttaagcaaaaaaggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtccagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgctt

SEQ ID NO: 18600 - DNA, 1318 bp, Homo sapiens
  ENST00000458729
gatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaactaatacttgtgtctgaagataacagtaattttttattcttgtgtcccctactgggcacatcaaagtgctttttggataaaatatgctcaagtaatggatacgtatattaacatataagtatattctgaaaactgacct

SEQ ID NO: 18601 - DNA, 383 bp, Homo sapiens
  ENST00000475955
agctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaactctctaaagaagatggacagaacattaatcttgtataaaacagggaaaagcatcagcagatacagccgttttaagattggggaatcctggtgtggtggtgggcgcctgtagtcccagctacttgggaggctgaggcaggagaatggcgtgaacccgggaggggagcttgcagtgagctgagatcacaccactgcactccagcctgggcgacaaagcgagactcttgtctccaaaaac

SEQ ID NO: 18602 - DNA, 387 bp, Homo sapiens
  ENST00000459652
gggaactttgtccgtgtaattcagactttcaatcgcacacatttgtatgtctgtgggagtggcgctttcagtcctgtctgtacttacttgaacagagggaggagatcagaggggaatatttgatgagcctacttcgtgtttggagcatcacatgcttttgttataccccatttctcttctattatttgcgagactgattcagagctttctgagatttcaacagtactcactcacctaaagagcctggaatccttgctacatgaagacctaaccacggttcttctcctgtgtctactatctttactccttgtcttctgttcctggaaaaagataaagcaatacaagtgaatcatgactttaaatgaatgaataaaacatcaacaaaaa

SEQ ID NO: 18603 - DNA, 577 bp, Homo sapiens
  ENST00000411788
tttcactcctcatcactaggtgggatgtaaatcaaattgccctgtagactatcttcgtttcacctgccattgtatcaccagtattctttgcaattggttgtatatgtacttttgggagaaacatataaggtattttcccttggatattaacttgcatatctgaagaaatggcattccggacaatttgcgtgttggttggagtatttatttgttctatctgtgtgaaaggatcttcccagccccaagcaagagtttatttaacatttgatgagcctaccttgtacaatgctgtgtgctacatctgtgggtacaaaaagaagtgtggcgtgaatttggtcctcagcaaccacctactctaaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatc

SEQ ID NO: 18604 - DNA, 785 bp, Homo sapiens
  ENST00000427167
gatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgagcctaccttgtacaatgctgtgtgctacatctgtgggtacaaaaagaagtgtggcgtgaatttggtcctcagcaaccacctactctaaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgc

SEQ ID NO: 18605 - DNA, 582 bp, Homo sapiens
  ENST00000487621
atgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgtaacaaaacgaagacacagaaacacttcttcaccactgagcattcgagagtgatctataccattctttcatcaaatttgctctgtg

SEQ ID NO: 18606 - DNA, 542 bp, Homo sapiens
  ENST00000470581
gatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgtgtctcacgctgtcaccaggttggagtgcagtgacacgatctcgg

SEQ ID NO: 18607 - DNA, 6265 bp, Homo sapiens
  ENST00000284136
ttagattaaattaacaccatttgaaagagaacattgttttcatcatgaatgctaataaagatgaaagacttaaagccagaagccaagattttcacctttttcctgctttgatgatgctaagcatgaccatgttgtttcttccagtcactggcactttgaagcaaaatattccaagactcaagctaacctacaaagacttgctgctttcaaatagctgtattccctttttgggttcatcagaaggactggattttcaaactcttctcttagatgaggaaagaggcaggctgctcttgggagccaaagaccacatctttctactcagtctggttgacttaaacaaaaattttaagaagatttattggcctgctgcaaaggaacgggtggaattatgtaaattagctgggaaagatgccaatacagaatgtgcaaatttcatcagagtacttcagccctataacaaaactcacatatatgtgtgtggaactggagcatttcatccaatatgtgggtatattgatcttggagtctacaaggaggatattatattcaaactagacacacataatttggagtctggcagactgaaatgtcctttcgatcctcagcagccttttgcttcagtaatgacagatgagtacctctactctggaacagcttctgatttccttggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacatgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacagacattggaactgtcctcaaagttgtcagcatttcaaaggaaaagtggaatatggaagaggtagtgctggaggagttgcagatattcaagcactcatcaatcatcttgaacatggaattgtctctgaagcagcaacaattgtacattggttcccgagatggattggttcagctctccttgcacagatgcgacacttatgggaaagcttgcgcagactgttgtcttgccagagacccctactgtgcctgggatggaaatgcatgctctcgatatgctcctacttctaaaaggagagctagacgccaagatgtaaaatatggcgacccaatcacccagtgctgggacatcgaagacagcattagtcatgaaactgctgatgaaaaggtgatttttggcattgaatttaactcaacctttctggaatgtatacctaaatcccaacaagcaactattaaatggtatatccagaggtcaggggatgagcatcgagaggagttgaagcccgatgaaagaatcatcaaaacggaatatgggctactgattcgaagtttgcagaagaaggattctgggatgtattactgcaaagcccaggagcacactttcatccacaccatagtgaagctgactttgaatgtcattgagaatgaacagatggaaaatacccagagggcagagcatgaggaggggaaggtcaaggatctattggctgagtcacggttgagatacaaagactacatccaaatccttagcagcccaaacttcagcctcgaccagtactgcgaacagatgtggcacagggagaagcggagacagagaaacaaggggggcccaaagtggaagcacatgcaggaaatgaagaagaaacgaaatcgaagacatcacagagacctggatgagctccctagagctgtagccacgtagttttctacttaatttaaagaaaagaattccttacctataaaaacattgccttctgttttgtatatcccttatagtaattcataaatgcttcccatggagttttgctaaggcacaagacaataatctgaataagacaatatgtgatgaatataagaaagggcaaaaaattcatttgaaccagttttccaagaacaaatcttgcacaagcaaagtataagaattatcctaaaaatagggggtttacagttgtaaatgttttatgttttgagttttggaatttattgtcatgtaaatagttgagctaagcaagccccgaatttgatagtgtataaggtgctttattccctcgaatgtccattaagcatggaatttaccatgcagttgtgctatgttcttatgaacagatatatcattcctattgagaaccagctaccttgtggtagggaataagaggtcagacacaaattaagacaactcccattatcaacaggaactttctcagtgagccattcactcctggagaatggtataggaatttggagaggtgcattatttctttctggccactggggttaaatttagtgtactacaacattgatttactgaagggcactaatgtttcccccaggatttctattgactagtcaggagtaacaggttcacagagagaagttggtgcttagttatgtgttttttagagtatatactaagctctacagggacagaatgcttaataaatactttaataagatatgggaaaatattttaataaaacaaggaaaacataatgatgtataatgcatcctgatgggaaggcatgcagatgggatttgttagaagacagaaggaaagacagccataaattctggctttggggaaaactcatatccccatgaaaaggaagaacaatcacaaataaagtgagagtaatgtaatggagctcttttcactagggtataagtagctgccaatttgtaattcatctgttaaaaaaaatctagattataacaaactgctagcaaaatctgaggaaacataaattcttctgaagaatcataggaagagtagacattttatttataaccaatgatatttcagtatatattttctctcttttaaaaaatatttatcatactctgtatattatttctttttactgcctttattctctcctgtatattggattttgtgattatatttgagtgaataggagaaaacaatatataacacacagagaattaagaaaatgacatttctggggagtggggatatatatttgttgaataacagaacgagtgtaaaattttaacaacggaaagggttaaattaactctttgacatcttcactcaaccttttctcattgctgagttaatctgttgtaattgtagtattgtttttgtaatttaacaataaataagcctgctacatgtaaaaagaaccaaactcacaatattaacataaacatctttcatattttgttagtactttcaaatgttttcaatttgactttccctctgaatatgcatggtgtgtttcctgtctgtttaagcagaactcacctttccttcttgtaacacagaacccttagccttcttctgttttgccttttcacgccctttatagtgtgaaatgaaaaattagtcacttcctcacatggaaggcagcttttcagaaaataacagacattgctcgtttctcatgcattctacatatcttgaaagaaaagtctgtgagaaaaccctgtgattagagggcaacttaatgcaagatctgtggctctatgttgagagcattctctctctgttatttttattttatttgcattgcttacctatctcaaagtagtcaaactgatatatgagattgagtactcccttttgatattatactgatgaatatttgtaggtgtttcactataaggaacagctaaggaataattttaataaaagtgaaccagaacaaatcactcatttaaaaagtaattcagaagaacagtgtggcatgatcagacttctaattgaatagcgtaacaacagtgtttgtaattatagatttgcttggacaaaatattccaggaactcatagcgagctcaaagcaattaagtgggaacatttttaatttaaaaaaaatttccaaatatttgtgggtccgacagtaatgatcaaaatatgaatgactttggaaaatttacatgaagctcaagtgttaggattgacttatgaaaataaattttatttctatccaaatttgaatgtccaaaccattttttagttacttctttctaatcctagttattcagacaaaatttggaaacttattttatgaccacatctaatattctggctgctttggatacaatactcttgatttatgataattagttaaaatatattaaaaatattattagtaaaataaaatttcacacaataaaaaacaacatagagtacacatatttatatgtatttttaaagataaagaatatctaaaatgtgtttttttcttagctttttagttgtctagaacatttagagaaagagtatgaatatattaaatccacaaacacactatatacttcctcaccactgactattttatcaaatttgccttaaaataatgaaaaagaaaagtatagttaatggtttcaaatatgctaagaaattgactctgcggaggggatcttaaaatgcctgtttactcatgttttcgtatttttcttgtctctaatacttttgtctttgtctgccttgtgtgttcttttctgaatttcatttcagcaatttatgctgctaaatagaatcccgcatgtctgcattcatttacattcaacttattgtaaattttgagattttatttagaaatgaattgtctaattaatttatgtagagtccttttttccaaagagctcaaaacactacatccacattattgacttttggaaaccaaccaaattacttaagaaatggaaaagtagtcacagagaaatttagtaatttgcaaaagccacaacagtagtggaagaattaaaattcataaagtctcatcattctgttggctaaaataatgctctttacaatatgctggctacaaaatggtcttactcttgaattttgcttttggttcatattttggttcttcatattctagtatgttttgttcctgctgaattttacagactcagctaaacaataagttattagtagtcacttgttttcattatcataattgaatttccaagaacaacttgatatcattcagctgtccaaaaaataataagagcattcattaaatactgattttcttaaacttaaatgttgtatttcatatttatttatataatacaaatggaaatcaaaactgaaatagcctccctttagaatgtcacatttttcttagaaaacattttggaattggttaaccttattgggaatggataatttagaaacaaaccaaaaaaaaaaaaagatatttgaagtgtttttataggagatgtatttttatcatagtaaatgatcacaattttaaataattcatcttacaagtcaggtaaaataaaatcgattcccagattccatacattaggagtgcaaagacaggatcatacacatgacttatacctctcatttaaatattttatagtataaagtatttatggaaagggtttgagatagatgatttttgggaaagggcaaaatgtgtcagatgccctagttaatcatgtaatttaattctggtattgtgagtggttagcaatcaattttgaatttataattctgctattttaaaagaaatgtagtcttgtagtatgaaataattaaaaattgttaaatgtatattttggttgtattataataaaatgcaaacatgactgttctatgattataaaaa

SEQ ID NO: 18608 - DNA, 1503 bp, Homo sapiens
  ENST00000484038
aacaaaactacagcaagacacagaaaggtgtgagctctggaactacacagttcatccattctccatgcagtctttcattttgaaaggagccaccttctatagaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacatgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacagacattggaactgtcctcaaagttgtcagcatttcaaaggaaaagtggaatatggaagaggtagtgctggaggagttgcagatattcaagcactcatcaatcatcttgaacatggaattgtctctgaagcagcaacaattgtacattggttcccgagatggattggttcagctctccttgcacagatgcgacacttatgggaaagcttgcgcagactgttgtcttgccagagacccctactgtgcctgggatggaaatgcatgctctcgatatgctcctacttctaaaaggagagctagacgccaagatgtaaaatatggcgacccaatcacccagtgctgggacatcgaagacagcattagtcatgaaactgctgatgaaaaggtgatttttggcattgaatttaactcaacctttctggaatgtatacctaaatcccaacaagcaactattaaatggtatatccagaggtcaggggatgagcatcgagaggagttgaagcccgatgaaagaatcatcaaaacggaatatgggctactgattcgaagtttgcagaagaaggattctgggatgtattactgcaaagcccaggagcacactttcatccacaccatagtgaagctgactttgaatgtcattgagaatgaacagatggaaaatacccagagggcagagcatgaggaggggaaggtcaaggatctattggctgagtcacggttgagatacaaagactacatccaaatccttagcagcccaaacttcagcctcgaccagtactgcgaacagatgtggcacagggagaagcggagacagagaaacaaggggggcccaaagtggaagcacatgcaggaaatgaagaagaaacgaaatcgaagacatcacagagacctggatgagctccctagagctgtagccacgtagttttctacttaatttaaagaaaagaattccttacctataaaaa

SEQ ID NO: 18609 - DNA, 1257 bp, Homo sapiens
  ENST00000463315
cagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcgtaagttccttctttccttctttcttggaaaggccttactgcctaattaagtaacttggcatttatttccctttggctccaaatgcctgattaattttacctgagcaaaccttacaggagtggttcttactaaaattcacacgcaaagtacacggaagtgctctaggtctgggcacacgtcataatgcagtaactcttctctttgtaagagtcctcaaagtaagtgaaggaaacaaaactacagcaagacacagaaaggtgtgagctctggaactacacagttcatccattctccatgcagtctttcattttgaaaggagccaccttctataggtaggaaaatcttggattccttattccacgggtgccctctgctggcaagtacaggagatttggtgaacactgtccctccgacttgttaatgaaagaataatcagaagcagtagacagcttcttctatttcacttctcctcttcactccctcaaaaactccttccaagtcctacaatgatttttttcttttttgtttatgtataatgttagcatcattagcttttagcttcttgaacttgttcttatttttgccatgtaatgtaaaaatgataatctatatcatggaattatttcatcagtattgtgtattttccaacttaaagtatacattgagtaatcgtggatgacctctcctattgtatgtaagcacattcacatcttaatcttttaaagaatattatttgcacataacttactgtcaatacggcactaatttgggggtagctattttcttattgttaccaaataggtaaatgaggtcaggtgtggtggctcacacctgaaatcccagcactttgggaggccgaggtgtttggaccacttgaggtcaggagtttaagaccagcctggccaacatggcgaaaccctatctctactaaaaataaaaaaaaaaattagccgggctggtggtgggcacctgtaatcctagatactagggaggctgaggcaggagaattgcttgaacccaggagggagaggttgcagtgggcagagattgtgccactgcattccagcctgggtgacacagcaagactccatc

SEQ ID NO: 18610 - DNA, 1605 bp, Homo sapiens
  ENST00000444867
agcttcccggctctgccagggctgccggcggctccgcttgctcagccagggctgcggctcagaggaacgcgcgccggtgccccgggttgccgcgccgctggacctcagcctgcatcccgttcccctctccctgaaaaggcaccaggaaaagagagagggagagaagagttcacagcaggtctttacacttggactagaactgtaacatctgctgtcctggttgccaggcttttgaacatacactgttggttctcctggatcttcaccttaccaactgcagatcttgggactcatcagcctcaataattatattaaattaacaccatttgaaagagaacattgttttcatcatgaatgctaataaagatgaaagacttaaagccagaagccaagattttcacctttttcctgctttgatgatgctaagcatgaccatgttgtttcttccagtcactggcactttgaagcaaaatattccaagactcaagctaacctacaaagacttgctgctttcaaatagctgtattccctttttgggttcatcagaaggactggattttcaaactcttctcttagatgaggaaagaggcaggctgctcttgggagccaaagaccacatctttctactcagtctggttgacttaaacaaaaattttaagaagatttattggcctgctgcaaaggaacgggtggaattatgtaaattagctgggaaagatgccaatacagaatgtgcaaatttcatcagagtacttcagccctataacaaaactcacatatatgtgtgtggaactggagcatttcatccaatatgtgggtatattgatcttggagtctacaaggaggatattatattcaaactagacacacataatttggagtctggcagactgaaatgtcctttcgatcctcagcagccttttgcttcagtaatgacagatgagtacctctactctggaacagcttctgatttccttggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaaggagaatttgtgctttgaagattgatcttatttctgaacatagtcaaagtaatttggagctgtatttggagaaagttgcataaatgatttgaacaatgcaaattttggtcaagagatatcaatgaagagagacacaataaataaactgacttaaaagataattttactgggcaatattgatcaatgagagcctgaggcgaataagtgccttcatccacagaatatcttttaaacttaatatgtttataattatacatggtagagcacatttcctaatgaattatttttagtagtgttcctactttccagtcaaactacttactctatttttccaataaattgtttaaccttgaaggatttctaaagtccttgtcaagctctacagttctttcatt

SEQ ID NO: 18611 - DNA, 6476 bp, Homo sapiens
  ENST00000307792
cagtttggcaagtcagtgcaagaggctgacttctgagaggcttccaggagcccgaagagaggacctccacgggagaagggagtgcgtgtgctcggttttgtttttttctctcttttttttttttttttctgaatgaacagctttgcccaagtgactgaaaaatacagcttcttcctgaatctaccggcgtagttgctgaagagcgctctagacaggacatggctctgaagactcactctttggaatgtcctcttgctcccggcttataaacaactgtcccgaggaaagaaaggttttacatagccaaatacagcctgacaaatggcacttcggaactgtgctttctgatgacaacgcgttcgatttctgacaaagcctctcgcacgctgcccctggagggaagtcctaagtaaaactcagaccctccttaaagtgaggagcgagggcttggacggtgaacacggcagcatggcatccgcggggcacattatcaccttgctcctgtggggttacttactggagctttggacaggaggtcatacagctgatactacccacccccggttacgcctgtcacataaagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaagaaccaaaatttgtaggttcatacatgattcctgacaatgaagacagagatgacaacaaagtatatttcttttttactgagaaggcactggaggcagaaaacaatgctcacgcaatttacaccagggtcgggcgactctgtgtgaatgatgtaggagggcagagaatactggtgaataagtggagcactttcctaaaagcgagactcgtttgctcagtaccaggaatgaatggaattgacacatattttgatgaattagaggacgtttttttgctacctaccagagatcataagaatccagtgatatttggactctttaacactaccagtaatatttttcgagggcatgctatatgtgtctatcacatgtctagcattcgggcagccttcaacggaccatatgcacataaggaaggacctgaataccactggtcagtctatgaaggaaaagtcccttatccaaggcctggttcttgtgccagcaaagtaaatggagggagatacggaaccaccaaggactatcctgatgatgccatccgatttgcaagaagtcatccactaatgtaccaggccataaaacctgcccataaaaaaccaatattggtaaaaacagatggaaaatataacctgaaacaaatagcagtagatcgagtggaagctgaggatggccaatatgacgtcttgtttattgggacagataatggaattgtgctgaaagtaatcacaatttacaaccaagaaatggaatcaatggaagaagtaattctagaagaacttcagatattcaaggatccagttcctattatttctatggagatttcttcaaagcggcaacagctgtatattggatctgcttctgctgtggctcaagtcagattccatcactgtgacatgtatggaagtgcttgtgctgactgctgcctggctcgagacccttactgtgcctgggatggcatatcctgctcccggtattacccaacaggcacacatgcaaaaaggcgtttccggagacaagatgttcgacatggaaatgcagctcagcagtgctttggacaacagtttgttggggatgctttggataagactgaagaacatctggcttatggcatagagaacaacagtactttgctggaatgtaccccacgatctttacaagcgaaagttatctggtttgtacagaaaggacgtgagacaagaaaagaggaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgagactatctactgtcttttgaagaatttatatttggaaagtaaaaaagtaaaaaaataaatcatccaacttctttgcattacttaaaagagatttctgtaatacaggaatgactatgaaggtgttataataaattattctacatactcatttgactggataaactttacataaaattaactaattttttaaataaatgcattgcttaatggtttctcattatgtttatcaaaaaacaactgtagctgttattttcagtacttggctgcttttctgtgaaaattattattttacttttggaagacaagattattagaatattgaagaaaaattggagacttataatcatggtaaatataaaactaaatatgttttaatatttctgaatttttcttttccatcacaatgtaagatatgcagaatacaagatactttggcattctcatgtgaactttctgtactctttaaggattattttattagtgttgtttaagccatgagtgttaagtagcaggtgtgttgtgagtgctgtaacccatgaaaggaaaaatgtcattctgaggcttgtgcccttcgtaaaatattcattaaagtacattcacactatttttgctttataacacagtctttaattttcactcactgtggaaataaaaactaaggtaacttctcagaaagatatcaaatctcagaaagaatgtcaaatcagatgaagttatagttaggattctaactactgtaaaagatttttgcttccctcttgtggtaaaaaaaattatattctcacacatttcttttttctctacagacggatatctgtttaggaaagatttgaaagcagattatcagtaggtacatggatacatcaagttcatttgcagaaacaaataactgaaataaaaaacatgttaatccttgtatcatactttaatatgaaagtattgtttatagataatttatctcacaagtcaaaaatgaagattttgcagcactgaaaatctattaaagctccaaattttaagtttctaaataatcttcgctgaaatctaaaatatactataacaaccgtgttttatttgtgaaaaaaatattaaagtgatttgctctcaaatatcaaattttcttctctcttttatattaagagacagaaaattgtttcatgagttcacttaactactgagatattcagagcatttttacctctctcttaaatgttataaaaaacaattgtatttttaagaatgtttatttatcaaagtctttccttcttctattaaatatttagcaattacctttctaaaatatgaaattttgtaagatgttttcacctaaataaaaattgaaagcaagtggattacacaggagaaccattatgaacatttatttagatattaatcttaaacagtgtttatttcagttttcaaagttagcttataggttatacatttaagttaaagtgctcataatcacttgcaatttcattgtaaaatgaacaaatacataaatattttaagaaaaatttaagtttattcagataagtcaccatgcttcaaaagatctaagaaatgcaaatatactgaaaattgacatcctctgaaaattccacttgctatttacccaagaatccactggaggtcattactgccattaaataataactgaaaagactatgtagtgaaatgtatttttaaaaactatattcagtaaaagcctgctcaatttggagaaatagaaccacaaacacagatcacaggggccttacaaagtttatgtctgaacaaataagtcaattaagtacactttattgaaaattgccttccattaacacacaagaaagaaagcaggattttctcctgtatctgaattttaaaattaaaaaggcagataagacataaatagttatcattttaattgcaataacacagacaagtagttaatgatgataacaatggtgtaacttgtaaactaaatatttggtaactgaagcaataggcagaggaaaatagcttttctatgacacaagtcataagaagtccatatactgaagagcgtttgattaaaataaagtgactattaaccagaaaagaaacattttacataaaatgctaaaatttattataggaaaataaatcaaacccaaagaaagtttattcaatgctaatttgaaagaaaattgataagaaaactttgagggcccaagtccacaatttggtgagaccactaaattttacatataattatacacacacatatgtacatatatatgtatataatcttgcttcccgcctgtttatggcagtactgaagagaaatgggaaagaagagggagggagagagaaagacgaagggagagagaaagcagtttccaaggatatgtttcatgtcccaccattttctcagtttctccctctctctcccaacacacacacacacacacccctcacatactataaaataaatcttcactgccctatcaaaatacaaataaatcaatctatgctgttctgtccttcttgagaatctaaaacataccacaaaaatacatccccagtcttttgttctgtctgaggttagaattaattcaaattcagaatctgttgtgagaaatgcccaggctttaaaaattaaaaatggatggatcttctctgaactcagggagggcacatacttagatacctacaagacttggaggaattaagagttcacccttcatctcaccaaattttccccatttttctctttcttgtagaaggagagaaaccatgctctctagcaacattgagcaaaaatcataaccactcatctaatttctaagaggcacctccatcgagggccggtctcctgcttctttagacctcttctatctttgttacaggagaggacctgtggatagacttagttttgacataaaacaatgcccattcacctcctccttcagcacaacgtcacccattgggcaagagatccagatttgttaacaaaaaagattttacttcgtgattccacgtctataattctatattgctaattttttcttttgtgtgaattactgaatatttcagagcaaagctatcaacttggagaaacagggattaaaaataaggataaacactaataagagctctagaaaaaagggaacagaaagtctgcctgtttagtaagtggcaattccatacatattttagagttttttctatctaaaattagttaaatacttagaatgtttgtaatgagtgttcgatatttgctataggttttagggttttgtaaatcttcatagtaattataaacatttgtaaaatttgtaaaatactataagtcattttgagtgttggtgttaagcatgaaacaaacagcagctgttgtccttaaaaatgaattgacctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctc

SEQ ID NO: 18612 - DNA, 2414 bp, Homo sapiens
  ENST00000427262
aaactaaacagtgtcctataggcagctatcagctcagcatgtgttgtttacttggaaagtgaaagaaagtctcccactttgccttcccttagatgaacagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaagaaccaaaatttgtaggttcatacatgattcctgacaatgaagacagagatgacaacaaagtatatttcttttttactgagaaggcactggaggcagaaaacaatgctcacgcaatttacaccagggtcgggcgactctgtgtgaatgatgtaggagggcagagaatactggtgaataagtggagcactttcctaaaagcgagactcgtttgctcagtaccaggaatgaatggaattgacacatattttgatgaattagaggacgtttttttgctacctaccagagatcataagaatccagtgatatttggactctttaacactaccagtaatatttttcgagggcatgctatatgtgtctatcacatgtctagcattcgggcagccttcaacggaccatatgcacataaggaaggacctgaataccactggtcagtctatgaaggaaaagtcccttatccaaggcctggttcttgtgccagcaaagtaaatggagggagatacggaaccaccaaggactatcctgatgatgccatccgatttgcaagaagtcatccactaatgtaccaggccataaaacctgcccataaaaaaccaatattggtaaaaacagatggaaaatataacctgaaacaaatagcagtagatcgagtggaagctgaggatggccaatatgacgtcttgtttattgggacagataatggaattgtgctgaaagtaatcacaatttacaaccaagaaatggaatcaatggaagaagtaattctagaagaacttcagatattcaaggatccagttcctattatttctatggagatttcttcaaagcggcaacagctgtatattggatctgcttctgctgtggctcaagtcagattccatcactgtgacatgtatggaagtgcttgtgctgactgctgcctggctcgagacccttactgtgcctgggatggcatatcctgctcccggtattacccaacaggcacacatgcaaaaaggcgtttccggagacaagatgttcgacatggaaatgcagctcagcagtgctttggacaacagtttgttggggatgctttggataagactgaagaacatctggcttatggcatagagaacaacagtactttgctggaatgtaccccacgatctttacaagcgaaagttatctggtttgtacagaaaggacgtgagacaagaaaagaggaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgagactatctactgtcttttgaagaatttatatttggaaagtaaaaaagtaaaaaaataaatcatccaacttctttgcattacttaaaagagatt

SEQ ID NO: 18613 - DNA, 626 bp, Homo sapiens
  ENST00000442159
gttcaaactggacgaacctacaattatcaaaatctcctcttagcattaagaaggcagtcaggactcagcagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaag

SEQ ID NO: 18614 - DNA, 571 bp, Homo sapiens
  ENST00000453333
gagcgctctagacaggacatggctctgaagactcactctttggaatgtcctcttgctcccggcttataaacaactgtcccgaggaaagaaaggttttacatagccaaatacagcctgacaaatggcacttcggaactgtgctttctgatgacaacgcgttcgatttctgacaaagcctctcgcacgctgcccctggagggaagtcctaagtaaaactcagaccctccttaaagtgaggagcgagggcttggacggtgaacacggcagcatggcatccgcggggcacattatcaccttgctcctgtggggttacttactggagctttggacaggaggtcatacagctgatactacccacccccggttacgcctgtcacataaagaatgaagagtgtttcttgtcagaggtgggatctcatctgggccttcacaacttgaatgaagaaaagacatggaggaggaaactgcaggctcaagtaaaaagagctcttgaatctgaacagaacatcaatatttcatagcccttttggatttcttgatctccatacaatgctgctggatgaatatcaag

SEQ ID NO: 18615 - DNA, 4899 bp, Homo sapiens
  ENST00000231721
atggccccctcggcctgggccatttgctggctgctagggggcctcctgctccatgggggtagctctggccccagccccggccccagtgtgccccgcctgcggctctcctaccgagacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccctcgccctggcgtgtgccccagcaagatgaccgcacagccaggacggccttttggcagcaccaaggactacccagatgaggtgctgcagtttgcccgagcccaccccctcatgttctggcctgtgcggcctcgacatggccgccctgtccttgtcaagacccacctggcccagcagctacaccagatcgtggtggaccgcgtggaggcagaggatgggacctacgatgtcattttcctggggactgactcagggtctgtgctcaaagtcatcgctctccaggcagggggctcagctgaacctgaggaagtggttctggaggagctccaggtgtttaaggtgccaacacctatcaccgaaatggagatctctgtcaaaaggcaaatgctatacgtgggctctcggctgggtgtggcccagctgcggctgcaccaatgtgagacttacggcactgcctgtgcagagtgctgcctggcccgggacccatactgtgcctgggatggtgcctcctgtacccactaccgccccagccttggcaagcgccggttccgccggcaggacatccggcacggcaaccctgccctgcagtgcctgggccagagccaggaagaagaggcagtgggacttgtggcagccaccatggtctacggcacggagcacaatagcaccttcctggagtgcctgcccaagtctccccaggctgctgtgcgctggctcttgcagaggccaggggatgaggggcctgaccaggtgaagacggacgagcgagtcttgcacacggagcgggggctgctgttccgcaggcttagccgtttcgatgcgggcacctacacctgcaccactctggagcatggcttctcccagactgtggtccgcctggctctggtggtgattgtggcctcacagctggacaacctgttccctccggagccaaagccagaggagcccccagcccggggaggcctggcttccaccccacccaaggcctggtacaaggacatcctgcagctcattggcttcgccaacctgccccgggtggatgagtactgtgagcgcgtgtggtgcaggggcaccacggaatgctcaggctgcttccggagccggagccggggcaagcaggccaggggcaagagctgggcagggctggagctaggcaagaagatgaagagccgggtgcatgccgagcacaatcggacgccccgggaggtggaggccacgtagaagggggcagaggaggggtggtcaggatgggctggggggcccactagcagcccccagcatctcccacccacccagctagggcagaggggtcaggatgtctgtttgcctcttagagacaggtgtctctgcccccacaccgctactggggtctaatggaggggctgggttcttgaagcctgttccctgcccttctctgtgctcttagacccagctggagccagcaccctctggctgctggcagccccaagggatctgccatttgttctcagagatggcctggcttccgcaacacatttccgggtgtgcccagaggcaagagggttgggtggttctttcccagcctacagaacaatggccattctgagtgaccctcagagtgggtgtgtgggtgcgtctagggggtatcccggtagggggcctgcagggagccagagggtggaaatggcctctaagctagcaccccgtaagaagagcctacctgaccgacttggggagggaacacagaggtgttgggaaggtggagcaacaatgcacctcccctcctgtcgcgccgtgatatcttggtggctccctgccactgcccaccgcctcttctccatctgagaatcacggagaggtgtagataatctagaggcatagactgctagagcccccagggatctggggtggtcagggctcaggcttcactttgtaaaccaggtgggggcatctcacagcctgacttcccttccccaggccagggttgctgggatgcctgcccctcctgagaggaccccctccccattgtcaggctctccatgtccacgagcggggaggggtgggttctggggcattgttgtcccttgtgtctgtggactagagatagggtgggggagctggggaagggtgcaggcgggaagagtgggctgtctttcccagggtgatgcaagcatgccgcagccctggaggctgggaatgtggaggctctgtgagccctgcagccctcagaatcagggccagggatgcagaagattgagaggatatggagatggatagagggcaggagacccttaggatagattgtgggacccaggcaggaacaggtgtccacaagaactcaggatggcatcagttagctcagaagccacctggaagacccagtgtttccatctctggaatctctgttttatgctaaatggatttaggaagactgtttttcttttaagggggaaacaaggtagagaaaaggacgaagaagtgtaagtcccgctgattctcgggggtaaggctcggatggcaaggacgcgttctgcctgggcatgtaggggaggtgtttttgccatcaccagtttctcaggctggggagcacagaggggaggaggaggactaaatgaaaagttgttcccagcctgcacatgaacacattcatgacacacaaaactggctggaaggagataagagcactgggtttgagattccctccattaaaacaaccaagacaaagaaaggaggggaaaaaaagataaaaagcaagccagggttccctgccctattgaaactcaaacccagactgccttgggttttatctttcccttacccctggcacctccagagaactgggacctgaaatagtccctccgttctcccctttgaccatgtaataaatgaaccagaagcactgagattaacctatcaacgccctgagaagccttccagcctgcggtgctgtctgctgggaggtcagctggtcaaggcagaggaggagaggaggaaaggatgggggctgaagagcagaagggaggggagacagaggggattaaagaggggaggagagagtgcagagctccaggaaagggtatcagagctgcagccagctctgccctctaccctagggaggccagaaagacacaaacagccctccgggcctttacgctggactctggcttggcaggctccaggcagggtcctctgggaagttactctagaaaacgaagggaggaggagcacaagatcctcagcaacgaacacctgcacttagaaaaagtggacagcttctgccaaccacaccctacccatggtactgtatgctattaactcctggaaacgccccgtaaatgcgagttgtttttgtatttgtgtgttgagatgggccttgtggtttctctgtactcagagcacatttcttgtaattactattgttatttttattgtcatgactgcccctgagctctggtgagaaaagctgaatttacaaggaaagggatgaagttaatatttgcatcacataattatatcattactgtgtatctgtgtattgtactaaatggactgatgctgcgcacatgagctgaaaatgaagagccctcccatccattccatgagaaagaaggtcaccctgagtgacttctgtttcatgatttcccaaacaggttttagagctggaaaaggacttaaagaaagagactgggtggtgctttctagaaaggaggaagatgggtatcaggggaaggaaggagttagagggctttgtacaaagccgagattgctcattaaatgaggaacatcctggcc

SEQ ID NO: 18616 - DNA, 848 bp, Homo sapiens
  ENST00000465657
gtagctctggccccagccccggccccagtgtgccccgcctgcggctctcctaccgagacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccc

SEQ ID NO: 18617 - DNA, 616 bp, Homo sapiens
  ENST00000475739
agcgggaccagagggcggctctgcaggcaggcggcagcggtgccctcagttccccagcatggccccctcggcctgggccatttgctggctgctagggggcctcctgctccatgggggtagctctggccccagccccggccccagtgtgccccgcctgcggctctcctaccgaggagccatggtccgaaagccttccagcaccatgtggatggaaacattttccagatacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccggggg

SEQ ID NO: 18618 - DNA, 2710 bp, Homo sapiens
  ENST00000537934
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggc

SEQ ID NO: 18619 - DNA, 5684 bp, Homo sapiens
  ENST00000450295
attacgtggctcctgtgttaatagaatcatggagggatcagcgtcggctcctgagcgtctgcagtcctgcacgtggctctggttttgcgattctgattctcttgatctaattgttggtgctgctactgcaccccacgatccctgtcttgagactgatctcccacactgcaaaggagtgacagccatgctatggaaccttgccacaccacggtggacaccgttctgtttggctgaaaaccagccatccaaaaataaaggaagatgaacagctctttagtgcttgtaattatgccatatgtgtttctgctttttccttctttgcctcatgaagatgaattttaaaggatacatatctggagctaatagacaattagatagtacttttttggttcacagactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttgatttggggaagacattccttagcggaggctgtgcagcctcccgcccctgcatggcccaggcgggacagctgggctcgctcttttctgtccgtttcctgctgtgttttgccctctctggcctgtgacgtgctcctggcgacttcttcctcagtgccctctcttttctgtcctctctgtctcacagcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtgagttgggccctctctgtcccctgtgccctgtccatctgtctcctcccacaggtggggggcgggcgggggcatcctccacatccctccacatgttcctttaccttccttatctgtcctggctgcgtccctcgggttgagccgtttcacgctttcattgtgggtccatcccgagggaaactgtagacagtgtgaagccacttctagtgtacaggggtcaaccagtgttttctgtaaagggctagatatttaggccttgtgggctgcaggctgtgtcacagccactaagctctgctgttgtattgtaaaaccagccatagtcaatacacaacgagtggtcagggctgtgtgccagtaaaactttatttataaaaatgcacggtgggccagatttgccccaaaggccccagtttcccaacctgtggtatataggattgcttctccctt

SEQ ID NO: 18620 - DNA, 4824 bp, Homo sapiens
  ENST00000438547
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttga

SEQ ID NO: 18621 - DNA, 4382 bp, Homo sapiens
  ENST00000422704
agcgctctcgcgcgccgcagcatcccagccgccgctgccgccgccgggcctccccgccaccccctccccggcccggccgcctcccgccgctgccgccgccgccgccgccgccattcctggcgcccgaactcgcccggccgggagccgccgcgggcaggacgcgcgctgcagactctgctaacaccagatagtggaaagaaaccatgtgctgaaatgtttgacgacactgatggtttgcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtg

SEQ ID NO: 18622 - DNA, 969 bp, Homo sapiens
  ENST00000486935
gagaggctccccgcccacaggtgctcacattctggctcgggggacgaggttgggcttcgaggtggtgtgcttcagcctctggctgcagccccttctcacctatagtgaggccgggaagatgaccgggagtgccaggctcatgcatcctctgctgcagggaggagatctggaggtggggactgaacagcctccccactggctaagagaaacacgtgcagagaagcgctttgctggagggcaggcacctgtgggtgcccagacaggggagagagggatttggacctaaggcccagtgagccctgacatagcacgtggattctgcaggaaggtcacagacctgccttgtttgcctctggttctgagtacctctcctccttactgcaatgtcccctgaaggtacactctggctgcttcccacacactggtgcagaagcagaggccatgctcctggatgcctgcttgcctgatgctagttcttctctgtctcatacacgcagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcg

SEQ ID NO: 18623 - DNA, 176 bp, Homo sapiens
  ENST00000540183
gagagccccagcaggtatggggcgggatgcgctgcctggggatgtcccccatgtgtgtgggtgaataacacgtgccggttgttttgcaggggtttgattcaggagatgagcggcgatgcttctgtgtgcccggataaaagtaaaggaagttaccggcagcattttttcaagcacgg

SEQ ID NO: 18624 - DNA, 599 bp, Homo sapiens
  ENST00000544513
gttggtgaggattcttggggtcaaccatggaacagtttattttccttggaaaaaaactggaataacccataacacttgggtttccagttgtctgttttgccaaagccttttcctttttttgtttctaatgcgaaatcatcattgttttctaagtatctgtggagggaatgacttgagagtgaagagtgtgaagtttgccgctgtggtcactgtccttggtttctgtgtctgggttagtgtcactgacctgtagctttggccctgcagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccg

SEQ ID NO: 18625 - DNA, 528 bp, Homo sapiens
  ENST00000474258
cgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacaggtgggttccgagggcttggcaggcttgacagtgacagcacatctgtgtcctctggtaggaaaactgggaaatccaattattctttcgtgagtagttccattgcctccctcgaggtgacctgggaggtttgtgggagcgtaagaagatttctgagaagtcaccacaccaggtggctttcagatctgggaccaccaggctactggaggtacttgtt

SEQ ID NO: 18626 - DNA, 907 bp, Homo sapiens
  ENST00000420681
agagcccttgaaacccctgcagtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctgg

SEQ ID NO: 18627 - DNA, 602 bp, Homo sapiens
  ENST00000433650
ggtagctggaggagcgggaagcactgactcctgaagaccctggcttcgctttcctgtgtccgttgggctgtccacttctaagactctctttgtcccccgctgccttccgtattcctcagcagatggacccggcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcact

SEQ ID NO: 18628 - DNA, 826 bp, Homo sapiens
  ENST00000540475
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcc

SEQ ID NO: 18629 - DNA, 563 bp, Homo sapiens
  ENST00000418828
agtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaagg

SEQ ID NO: 18630 - DNA, 433 bp, Homo sapiens
  ENST00000420670
tttggtcgcggaggccgcggaccctgtgcactggacccggcgccgcgcactcagacagactctgctaacaccagatagtggaaagaaaccatgtgctgaaatgtttgacgacactgatggtttgcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatg

SEQ ID NO: 18631 - DNA, 317 bp, Homo sapiens
  ENST00000464051
agaaggtttaaactcacaataatttgttttcagtgcctttctaggagtgttgctgagtttaagtggatgcacagtttaagggcttaaatagccttgtttcccattattttcacagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctg

SEQ ID NO: 18632 - DNA, 493 bp, Homo sapiens
  ENST00000482128
gcctgcggagaaggctcaccacgggaccttgtccctgcgctgaagggtgccttgttgtggctggagcagtcctggcctgagccccaactaataacagagcccttgaaacccctgcagtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaagactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattc

SEQ ID NO: 18633 - DNA, 4503 bp, Homo sapiens
  ENST00000356444
actctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatcctt

SEQ ID NO: 18634 - DNA, 4275 bp, Homo sapiens
  ENST00000420987
actctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaatgagtctcatgagtgttttgttctacctgctttcaagtctctaattattaaagctgtatctctgaagactgtgtcactgtgtgtgtgaacttgtcctaaagctactcagcctttaatcttacacacacgtctcttcttgtctgttgaatgacagttttcatgtctatcataaaaccaaagcctctgttaaaagtcaagccgcacccctctggtgatcctagcaaatactgagtgtcttcccagcagtgtgacaatgacctgttttgcatcccctctttctggagctggacaaattctctaccagcctttgtgtgggatcagcatacatcgcctgctaattccttcaggatccatcacaacaggtgtcctgaagatgctggagacaccctggttgtctccacacgttccccctccgcaccccaagtcgagaggcccagctgcctgtgaggtgtgtgcttgcccatccagccaaggatgccagtcttgctcacggaaccatcacatactcataacctgaagttttcctgtaaaatatccatcagctcactgtggttcttgctttgggtgtggcttcaaccactacaaactgatgagtgaaatgctatgggctttaggcttatattcttggtgctgttttctgtctcttctcctgaagtctggatttcaagcactttcacacttaacaaaataattacatacttgaagttttcgtaatgtggagtgttctactgggaaatggagttatgaggatgaatttctgagtctttctttgctctgctggaaaaaataaaaatagagttgtacattg

SEQ ID NO: 18635 - DNA, 4258 bp, Homo sapiens
  ENST00000339861
ccccgccaccccctccccggcccggccgcctcccgccgctgccgccgccgccgccgccgccattcctggcgcccgaactcgcccggccgggagccgccgcgggcaggacgcgcgctgcagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaatgagtctcatgagtgttttgttctacctgctttcaagtctctaattattaaagctgtatctctgaagactgtgtcactgtgtgtgtgaacttgtcctaaagctactcagcctttaatcttacacacacgtctcttcttgtctgttgaatgacagttttcatgtctatcataaaaccaaagcctctgttaaaagtcaagccgcacccctctggtgatcctagcaaatactgagtgtcttcccagcagtgtgacaatgacctgttttgcatcccctctttctggagctggacaaattctctaccagcctttgtgtgggatcagcatacatcgcctgctaattccttcaggatccatcacaacaggtgtcctgaagatgctggagacaccctggttgtctccacacgttccccctccgcaccccaagtcgagaggcccagctgcctgtgaggtgtgtgcttgcccatccagccaaggatgccagtcttgctcacggaaccatcacatactcataacctgaagttttcctgtaaaatatccatcagctcactgtggttcttgctttgggtgtggcttcaaccactacaaactgatgagtgaaatgctatgggctttaggcttatattcttggtgctgttttctgtctcttctcctgaagtctggatttcaagcactttcacacttaacaaaataattacatacttgaagttttcgtaatgtggagtgttctactgggaaatggagttatgaggatgaatttctgagtctttctttgctctgctggaaaaaataaaaatagagttgtacattgttca

SEQ ID NO: 18636 - DNA, 2396 bp, Homo sapiens
  ENST00000492386
gtatacatttggaaagtacccaaataaatgagaagcttctatccttgatttggggaagacattccttagcggaggctgtgcagcctcccgcccctgcatggcccaggcgggacagctgggctcgctcttttctgtccgtttcctgctgtgttttgccctctctggcctgtgacgtgctcctggcgacttcttcctcagtgccctctcttttctgtcctctctgtctcacagcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaatgagtctcatgagtgttttgttctacctgctttcaagtctctaattattaaagctgtatctctgaagactgtgtcactgtgtgtgtgaacttgtcctaaagctactcagcctttaatcttacacacacgtctcttcttgtctgttgaatgacagttttcatgtctatcataaaaccaaagcctctgttaaaagtcaagccgcacccctctggtgatcctagcaaatactgagtgtcttcccagcagtgtgacaatgacctgttttgcatcccctctttctggagctggacaaattctctaccagcctttgtgtgggatcagcatacatcgcctgctaattccttcaggatccatcacaacaggtgtcctgaagatgctggagacaccctggttgtctccacacgttccccctccgcaccccaagtcgagaggcccagctgcctgtgaggtgtgtgcttgcccatccagccaaggatgccagtcttgctcacggaaccatcacatactcataacctgaagttttcctgtaaaatatccatcagctcactgtggttcttgctttgggtgtggcttcaaccactacaaactgatgagtgaaatgctatgggctttaggcttatattcttggtgctgttttctgtctcttctcctgaagtctggatttcaagcactttcacacttaacaaaataattacatacttgaagttttcgtaatgtggagtgttctactgggaaatggagttatgaggatgaatttctgagtctttctttgctctgctggaaaaaataaaaatagagttgtacattg

SEQ ID NO: 18637 - DNA, 1837 bp, Homo sapiens
  ENST00000420101
agcccagagaaaaacaacagaggtttgcggcagaagtggccaatgtcgggcccagagtccatgctcaaggctggaagcccatcctggatgtgctgcactcggcagtcctagtgtaattctgcagggcctggcccctgccagggtctgagctctccagcctgtggcatctactcccctccaagcccaccccagtgtctcaattggagagacaggccctcatggtccccactctggcccagccccctctgcacacagctggccgagctctgggcctctccatgctgtggccctggtgatggcagagccttgggatgtctctgtccatgtggtcacaggacatgtgtgtggcagcagggccatggtggggtgggatgctgttccaaggcccagaaccattctgtaagaaaccagcacagcgctgcaagaaagggggtcctaggggacacaggccacacaggtgtgctttgaaaaatggcaattaaggtcaaagagcaggaagtccacaggacgggccaaggccaaggctcccgctggccatggggaagccacctccagggcagtcccagggactgaattggaagttgtcccaagtcacttcaggtccaactgggacagcagaggtaacccccctgcaccctcatggggcagcttctttgggtcctaaatgtggactcagaggtggaaacggtctgtgtccccaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatgg

SEQ ID NO: 18638 - DNA, 3053 bp, Homo sapiens
  ENST00000475255
tttgttttacctgctcagtgttctgaactccttccttttcactactaagcattctccatgaagccacacttcattttgtcattgtgaggttgatggacatctagggcaaatctaacttctaaagaccaattcttacgaggtgtcatggtcaagcagaggccatggccggcactggtctaggtggcccatggcccatttgggggccttggtgggcctcgaggaagggcaggtgctggtcagggagccgggtcgctaggcagcaggtgggtgtcaccccagtccacgctgctggggtgcctggcctgatgcaggctgtgcctgagggagacagaagcagcagagtaggctggccggcctccccagccccaccacaagcaggagcttcagagacagaaggagcacctgcaccccctcacctgccctccagggcctggcctggccctcccagctcaactccagggtctgtacgctctggggctggagcttagtgggactgtggcccccctcagccctttctgcatttgagtggaagccagtgtgcgaagcagatcaaaatggatgtgcttgtttttccttcagtaagaacagggagttgagcctgtcccaacatggccagcagcccctggagggccaacagacttcacgagcaaggaaggccgggaggtgacctgctgaccagaacttacttgtgcccctcccccccgcccaaaacccccaacattctggttttcacagccccaccccagccacctggaacaaatagtgtctaggagtagccctcagggttggccgcgcagacttcttgccctgggatgaggctggcctccccaggcgaggcagcctgggccacaggggaacgtctctgcctcgcccaccctcctgatctctccatcagacaagctgaggccagccaggctccaccctggcaggttgcaacagatggtctgagtgtgtgtgaagtaactggcctctctactttcttcaataagtaattaagatcaaaagcccagagaaaaacaacagaggtttgcggcagaagtggccaatgtcgggcccagagtccatgctcaaggctggaagcccatcctggatgtgctgcactcggcagtcctagtgtaattctgcagggcctggcccctgccagggtctgagctctccagcctgtggcatctactcccctccaagcccaccccagtgtctcaattggagagacaggccctcatggtccccactctggcccagccccctctgcacacagctggccgagctctgggcctctccatgctgtggccctggtgatggcagagccttgggatgtctctgtccatgtggtcacaggacatgtgtgtggcagcagggccatggtggggtgggatgctgttccaaggcccagaaccattctgtaagaaaccagcacagcgctgcaagaaagggggtcctaggggacacaggccacacaggtgtgctttgaaaaatggcaattaaggtcaaagagcaggaagtccacaggacgggccaaggccaaggctcccgctggccatggggaagccacctccagggcagtcccagggactgaattggaagttgtcccaagtcacttcaggtccaactgggacagcagaggtaacccccctgcaccctcatggggcagcttctttgggtcctaaatgtggactcagaggtggaaacggtctgtgtccccaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctggtaagtgattcccatgcccactgttacccttttatgaggtaatttttcactatttacaatggcagtgaaaaaaacagctggaaagcatgcttgcacggtggcattctgggtttgggttttattggctttccattgagaaaggtggccagtgggcatcaagggtgccataaaggcccacagagctttgacctggggaccctgcttgttttccagaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatgg

SEQ ID NO: 18639 - DNA, 3533 bp, Homo sapiens
  ENST00000469653
atataattttttaaccaaagtgcagtctttaccctgtcagggccctgccttcacctctgccaggactatcttccatgtcaagtttagacccgtgtcattttcaaagctaataatggttcccccatactttaggcagcatttagatatttggatttgggatggccttttatgttttaactacagtgttagaaatcagagcccttggaaccactgggatcagagggcagcagcagaaggcgcccttggtcctctttgaggggcccagggctctggagagggcccccgttcctagcagccacagtggcctgttggcacgcatgtgtgtgttccagctgctctgtgacatttccctttgtttcagactcttgaaaggccacggccgtcgtgggaattagttgaccttgtgtgttgggccacccttgctggacaggacaaggtggtgctatcaactccctgtgctctgaggtccttcgcatgttagatgaggcagcttcaccagaaactatccatgtctcttctgttatctgggataattccacgtgcctttacaacacagctgtctggttacctggggtctggaaatgccctcggtgcctcagtggtgccttcccacaggccccccatggagccaggcgatgcctacagatgcctcagtggtactttctcaggtccctttgcagagaagaggttcaggattcctgcccacattgataaggcggcttggccagtaagtggcaggcatgaacaggtgcattccagaagcgctggggctggtccagtgccctgagtggtctagagcataccagagtgaaacgttaggctgcgtcggcctggtgactgtcagggagatgaggactcagagaagggagctgtcagaattgctacctatgtggcaggggtctcactctctcctccctcctcttggggcccctggctactctgtgacttcaacagaggacagaaaggatgaccaacaaggcctcagggcatacccccagctgcactgtccttgtccccagaagggtccccagagtctgggagggaggaggggccatggccaggattagaaaagaccgtgccccaaggagagagcacagagatgggccagggaagcagtgggatcctcgggaaaagaggctgggagcaggtgtccgggtgaggcccgggcagcgggtacaggcagggacaagccaggagtcccatcatggaagacatgatggccagcggccagcactgtgtgcagagaatggcccctctggggatgtgcccgctgccccattagttgcaggaaggccacctggatgtgagtttgggagatgggctggccccgaggcagccagccctgaggtcagagtgggccacatgcatggggatgccgggaggacacagaggagtgctgcaggagatggcagtgggggcactttccaggatgggcccgagcaactcagtcactgggtggatgtctcaccacccctccaggccttcctcagggcgaggccactgcccagagggcacctggtttgtcgcagagtagaatcagctccatattttgtaatcacatccacgaagctctgaagccatggtggtcctggcaccagctggctccgttagaggcttggggtgggagtgagcaggtgggaggtgccccagtgacaggctgagtgctggagcccaggctgccaacagcctccccagactcctgagttgatgtaataaacccagccctggtgaataaacctggcccttgcttataccaaggtgatcagtcttctcacgacagtcctagctgtaggagaaagatcattacctacggcatctgccacagcagttaatttgccttcaacttaagctagttgcagtgacaggaagggccagggggaaatatctgtcctcaggacctctaccctagatccttgtaagccacaacaacttcccttctttgagggcgcgaccagtgtcacctggctcgccactgggaagagccaaggcacatccaggttggtggctgctgagccccacagcatcagaccagcctcttgtccccaccccacagaggccaagggggtgatctgggagtagcaccccagcctggccgctctcttgaggtaacagggttggatggttagggagcttggagcactggcccaagcaagaaaacagtggtgttttcaggaggccctgctgggagatggaagacagctccccactgggggcctaggattccaggagctccccagcagtcctccgtgggacatacgtgggtttgcacctgctgccctgtcccgctgagggtgcggtgctgatggggtggccctgcacactgatggtaactctcactttccctctctctcatgcattcagaaagagatggatagtttaaaaacgaatacatggaacgtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatgg

SEQ ID NO: 18640 - DNA, 3594 bp, Homo sapiens
  ENST00000455551
ctgcgcgcccgccccgcgcactccgtccccgcgccggcctcagcgctctcgcgcgccgcagcatcccagccgccgctgccgccgccgggcctccccgccaccccctccccggcccggccgcctcccgccgctgccgccgccgccgccgccgccattcctggcgcccgaactcgcccggccgggagccgccgcgggcaggacgcgcgctgcagactctgctaacaccagatagtggaaagaaaccatgtgctgaaatgtttgacgacactgatggtttgcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttctt

SEQ ID NO: 18641 - DNA, 2895 bp, Homo sapiens
  ENST00000429836
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaata

SEQ ID NO: 18642 - DNA, 2024 bp, Homo sapiens
  ENST00000519649
cctctcgcagctggtgctgtggggccgcggagccgcgcgtcgctgtctctatggccccggatccgagcgcaaagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagac

SEQ ID NO: 18643 - DNA, 4656 bp, Homo sapiens
  ENST00000521006
cgcagctggtgctgtggggccgcggagccgcgcgtcgctgtctctatggccccggatccgagcgcaaaggtgagcaaggcgaggagtgcgggcggcgccctggcgtgagcctggggctgcgggccgggggtcgggcaaggcctcccccacgtccattctaccctccaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccaca

SEQ ID NO: 18644 - DNA, 596 bp, Homo sapiens
  ENST00000518124
gctggtgctgtggggccgcggagccgcgcgtcgctgtctctatggccccggatccgagcgcaaagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggctt

SEQ ID NO: 18645 - DNA, 652 bp, Homo sapiens
  ENST00000518244
ggtgctgtggggccgcggagccgcgcgtcgctgtctctatggccccggatccgagcgcaaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggt

SEQ ID NO: 18646 - DNA, 3596 bp, Homo sapiens
  ENST00000370250
cagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcct

SEQ ID NO: 18647 - DNA, 2675 bp, Homo sapiens
  ENST00000517724
ccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccagggaagcaggacagcactgatacaggacatagagagaggaaatcgaggctgtgagagcagcagggatacaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttgga

SEQ ID NO: 18648 - DNA, 4094 bp, Homo sapiens
  ENST00000210633
gcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccagggaagcaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccac

SEQ ID NO: 18649 - DNA, 728 bp, Homo sapiens
  ENST00000519756
gagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacaca

SEQ ID NO: 18650 - DNA, 376 bp, Homo sapiens
  ENST00000518948
gctaccactctccagctgctcccgctaccgatcctgctatgactgcatcttggcccgagacccctactgtggctgggaccctggcacccatgcctgcgcagcagccaccaccatagccaacaggacagcactgatacaggacatagagagaggaaatcgaggctgtgagagcagcagggatacaggtaagtgactcatatgagtgtgggtctagctacgcagactgtcctctttgccatttactgccatgtgtacgtatatgtttgtatctgagtggctgtggctatgtacatttggtaaggatgactcaaacacagagcctggcacagagtaagtgctcaacaaacatttactgcccaaatgaattataaactag

SEQ ID NO: 18651 - DNA, 393 bp, Homo sapiens
  ENST00000476171
gcgggaaggcagacgagggcgccgacggaaatactcactgggtcgggccagccgggcaggaggatctgcggtgcaactgcagacagtctcaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacggg

SEQ ID NO: 18652 - DNA, 714 bp, Homo sapiens
  ENST00000484128
cctcccttcattacccccactccatacccttctcccaactttttgatgtccctgtagggctggccagtcaggcccagccaaagccccctcctcagtctccacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggagctatgactagtctgcttcatctagatgcgcccacccctgatcaccaggggacaggctcctgagcctatacagaaggtgatatctgcctccaggattggctctgctccccaatacaactatttgcagaggaaattgggatcctccgcttccatcctgactccttggcaggcacacaggcctctttagtaaggttcacactattcattgatcatggtgttagggcatgacaagaaaatgacaacagttcaagaatt

SEQ ID NO: 18653 - DNA, 1171 bp, Homo sapiens
  ENST00000613292
cacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttcccc

SEQ ID NO: 18654 - DNA, 11762 bp, Homo sapiens
  ENST00000382496
acttgccgggaaggcggcgccggtggcggctgctctccctgagcccgctcccgagcgctgctttcccgccgcgggtgggcttcgcagcctcaggccagccgcggcccttggcccgctgcagccccggccctccaccttccccgtgcaggggcggcccggccagtgtcgctcatcccgggacgctcccttctcccacccaggactgccccgcggagctggcttggacacccaactttgccacctcgagggtcgtctctgctgggcgcgaacctgcccacccaccggttggccgcgcgctcggggaccgtgctcgtggcccccaagccggtgcccccattctggaactcagcgagtagggggcggctctggggaagtggcagggggcggctgcagctgctgcctccacttccctagccaggtgctgaagaggatcctcggagccgctctggcccccaggcgctggatgactggcaccagcgctcctcgcacctgtgttggtgtgtgagacttgggctggagtgcccacgtggctgtggagtcagtgtgattcatgattgaggaaacgcgtcctccatcctctctctccttggcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgcaagaacgatattggtgggcgcttcctgctggaagacacctggaccacattcatgaaggctcgcctgaactgctcccgtcctggggaagtccccttttactacaacgaattgcagagtactttcttcctgcctgagctggatttgatctatggcatctttaccaccaatgtgaacagcattgcggcctcagctgtgtgcgtcttcaacctgagcgccatcgcgcaggccttctctgggcccttcaagtaccaagaaaactcgcgctcggcctggctaccgtatcccaacccaaacccccacttccagtgtggcaccgtggaccagggcctgtacgtgaacctgaccgagagaaatctgcaggatgctcagaagttcattctgatgcatgaggtggtacagccagtgaccacagtgccctccttcatggaggacaatagccgcttttcccacgtggcagtcgacgtggtgcagggcagagaagcgctcgtccacatcatctatttggccacagattacggaaccattaagaaagtgcgggtacccctgaatcagacctcaagcagctgtttgctggaagagattgagctcttccctgagaggcggagggagcccatcaggagcctgcagatcctgcacagccagagtgtcctgttcgtgggcctgcgggagcacgtggtcaagatccccctgaagaggtgccagttctaccgcacacgcagcacctgcattggggcccaggacccttactgtggctgggatgtggtaatgaagaaatgcacaagcctggaggagagcctgagcatgacgcagtgggaacagagcatctctgcgtgtccgaccaggaatctcaccgtggatgggcactttggtgtgtggtctccgtggacgccttgcacgcacacagatggcagcgccgtgggatcctgcctctgtcgaacccgctcctgcgacagcccggccccgcagtgtggtggctggcagtgcgagggccctggcatggagatcgccaactgttccaggaacggaggctggactccctggacctcgtggtctccctgcagcactacctgtgggatcggcttccaggtgcggcagcgctcctgcagcaaccccactcccaggcacgggggccgggtgtgcgtgggacagaaccgcgaggaaagatactgcaatgaacatttgctatgtcccccacacatgttctggacaggctggggtccttgggaacggtgcacagcccaatgcgggggtggcattcaagctcgccgcaggatctgtgagaatgggcctgactgtgcaggctgcaatgtggagtaccagtcttgcaacaccaacccgtgtcctgagctgaagaagaccacgccctggacaccctggacacctgtcaacatctctgacaacggcggccactatgagcaacgattccgatacacatgcaaagcccgcctggctgatccgaatttgctggaagtgggaagacagagaatcgaaatgcggtactgttctagcgacggcaccagtggctgctccacagatgggctttctggggatttcctgcgtgctgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccaggaatgcaacattttgccctgcccagtggatggcgtgtggtcttgctggtccccctggacaaaatgttcagcaacatgcggcggtggacactatatgaggacccgctcttgctccaatccagccccggcctatggaggggacatctgcctggggctgcacacagaagaggcactctgcaacacgcagccctgcccagagagctggtcggagtggtcggactggtctgagtgtgaagcctctggcgtccaagtccgcgcccgccagtgcatcctcctgttccccatgggcagccagtgctccgggaacaccacggagagccggccgtgtgtgtttgactctaatttcatcccagaagtatctgtggcaagatccagtagcgtagaagagaaaaggtgtggagagttcaacatgttccacatgatcgccgtggggctgagcagctccatcctcggctgcctcctcaccctgctcgtctatacttactgccagcggtaccagcagcaatcccacgatgcgactgtcatccaccccgtctcacctgccccccttaataccagcataaccaaccacatcaacaaactggacaagtacgactcggtggaggccatcaaggcatttaacaaaaacaacttgatcctagaggaaagaaacaaatacttcaacccacatctcactgggaagacctattctaatgcctactttacagatctcaataattatgatgagtactaacagctttcatgtttttggcttcttgtaaatccccagttcctcaaggcctgtgccccatgactgcccatgtttctgaggcttcagagtcgaagtttggatacatttcaagtgcatttcaagccaccagagtgtcccattgctgccaaaaatacacgtctttaaaagcaacaaaaattgaaataagacatcgtgaaaatcttgaccattgttgaatgagccagggtgtgaagtttttaattgtgttcatcctatttttctgacaagtccattggtttgttttttgagcattattttataaatgtgccacccacattggaaggagtctttctttagaactttggagtgtaaatcttcatgatgttgtaattcaagaaaataggcactttctctgaaagacctgctccttccacaagaagtgcataggtccataatatttcataaaatgaagaaaaagaatgtggccaaacaattattcaccatggattgcccaactttccaaatctggataaagctgtgggattcttggaagcagcttgagtgttttcatcttgcctgggaagcccaggaattccacctggtccacaccggcagaagttacagtagactgtgaggcaccccaccttgctcctgatgcagtttctgtgccattgctggtgctggtggaggcagcggagcagaggctcaggcacaatgaagcgtggatgtgttctgcaggttgctgcaaaactcaccttattctgacttttggatttcatggcattccaggaagctccttgccatgctgttggcctggaagtccacctgtctggtccatagtgacgtcctgaagagccagtctgtaaaataaccaaccacttacttagcgtttggatagactccatgccttctctctccctgcaaagaaaaatcttgaacatttatgatgtcaattagtgaaagtattgaaaatactaaattataactaaaagcaactttttatgttattgaaaatattgaaagaactgatattaatgataatcattttatttttcatctctctgatatacccaatgtgtggcaatcagcccctaccacgagcattaataccatgtaaagctggctttctggagtctgccaggtccacacgaagtgctacccccagtttctgctgttacttgctgcctccaggccaggggagcaggagatgctcagctctggtgccttttcttttatttcagtgctgccttcccacccacccagtccattcaccctcacctctccctgcatggaggcaacagcatttcaagatgtaccttgggaagtcaggatagctggaagtaagggtttttgggatccctgtggtctcttcactgatcatcgataagcatttaagagtgtgctaacaccattcacagaggtccctggaaaaaaatatataattttctcacaaacaaccaatacataacctatggcagttggttgaataattattgaaaaaaagaacacgactgaaaaagttcatctgatgcctctgagcatgtgataaagtcctgggtagacacggaaacgtgttcttacaaatgaaccttcggatctatgaaagaaaatatagtagggggactaaggaacatagaattttattagcatatgtgattttacccttatctttgtttctaatttaaagaaacaatttcagaaagtgttagaagaattctatgtttaataatgaatattgttgagttcaaaatattctcatatacccagatttacagagatgacacagtattgaaatggcaggtgggctctgtaagttattttggattaatgacattcagggtctttgcagtggggacttcatgttgcctctcactcattcctcatatgtcagagtcttctgtctatatgcacatgctcaaagtccatactcagtaggggaaatctagccggatggttctccaattgttcctcggctggattttcatcatcagatatttcaactcatctcatcagtttcttgtaagaaaaaaacattttcactttgtagcacattttagttatttttgagtcttcttccctaatagtttgtaagcttaaagggacattttattttccctggtaaagaggattctaatatttcaagaatgtttcactggaattgatgggaaatggtttctaaatggcatcgaagctggtctttaatgagtcttttgcaatgacttgggaaaaacaccctccctcactacaggatcttcatgttgttaataatataaacaaacctttgaaattagcattgcaaaagaatcccatttttgtttcgtaccacactgttcaaaggaaaattgtttatctctcttcctttctctctctctcttatttgacagaatagcaagtgtttagataatttcagatatattctaagtattttaccagctgtggaataagttgtgtttgtccatcactgtgtagctaccgttcacatgttctggctctgtactccacgcttatcgcgtgaaccctcacatgttggactttcacagtgtgatctctcacctgtcttggaaactccttcataaagccgctcttccttaggcctgggctgtttggaagtcctggtgaaactttgcggttcacattttaaattcctgaatgaccttttcattctctctttctttatctttgtttttgtccttcattccctccttttgttcttccttcctgccttcttttcttctttcctttcttctttctttaattcttcctttcttcctattttcttggtacaagtggaacaaaaaccaacacatagttttaagctacacctttctgcacctgatgtaaaatgacattaatcactatttaacttctaaaattatttctgaatacagttggagataggctggttttcatgaggaagctggcttggctttagtcttacatttaaattctttgaaagtggctcccagtgctattcagggtcctttcttgaggccagactcatcaccatctactattgattttacagtgcactgacagtttacaggaaggagaagaacagaatttctgcacactacacaacatgtgggcttcctgtagctccagggacatgtagctttggtgaaactggggttttgtaacctctgaatgatatggacttagtgaattctaaggaactcagggggcacgtggtcaggctccaccgcacagaagagccacagtctccagactcatggcgttccctccagaactccccattcccctctgagcatatttctatgctgctgcttcttgtgacttacatgaggcatctcagcttcttcatgtttgtagggatggttccctaagcctgttcaagtaggctctcactagagttaccattcatatttgagaagaaaagaacatttaataaatgtatgtgtggggctgaggttctaaaggaattgaaaagagacgataaacattgaatgagggtgagggcatccctgctggggagaaacctctgtccctaggaagagtccgttcatgtcatgtggtttgggatgaaccaggggtctggccccatcgggtcacaggtgatggcaaatagaaaagaagcaaatggaggaaatagtcggataagtaggtgacgtgaaaggcaggacctggtcaccccagcaagtgctatggacagttcccggaaacggttgcccacttcacaggtccatgggtctgacccttggactctgccaggatcaactgcccagagtgccagagttttagccaaaggtgtacttacttccttatttatctgcaaaaggatggaaactgtgggagtcaaagcctattttgctgagtgttcccactggagtctctggtagaattagcaggtcatgctgtcaaaatcatggacaaaggctgggtgcagtggctcatgcctataatcccagcactttgggaggccaaggtgggcggatcacctgagctcaggagtttgagaccagcctgggcaacatggggaaactccatctctacaaaatatacaaaatattagccagccatcgtggtgcgtgcctgtggtcccagtttcttgggaggctgaggcgggagtatcatttgagccaggaggttgaggttgcagtgagctgagatcacatcactgcactccatcctgggtgacagagagagaccctgtctcaaaaaaaaaaaaaaagaacaaagtcttagcggggggtctctatgtccccaagtggctctctaaggggatccattagcgtataattgaatatcaaagggaattttaccttaaacatatatcaagtctatactcagctaatcgttttgtctaaacacagccttgttagcatttgaatttacaaatattcatttgcttatttgcagtgttccttttgcttttagaataaatcataaatatttccccaatactgtcaagatacttcttcaactttgtccctgaaccatcagctttctttagggtccgggtatcctttacacttcaatggggttttcttgtgtgtgtcattgggggtaactccattgacctcagcatttctatctcaagagatggctctggaacacagaaccagaggcaacaggtactaatggttgataaaattaacagcgactgcataaccattttccacatggcagggctgtgcttaagccccacacctccaataatcaatttctatgacggtactaataaccttaactatatgcaaattcttcaccacttatgatatggtacaaactggagtttacagatggccttggccttgcctagcccatttgttcatcctaacttcttcatcacttcctgatgcacttggggaagcatgttgacacaacgttaccaatatttgattacctatggttatctgcaattacctacgcttatcttatcagaccctagatgccatttgagccccttacttctttgggcagtgggtgaaatgggagaacatagagaaatgttcactttgacctaagaaacgcataaaagggaatgccatgcacaatgtaagataaaatgtttggggacaggggatcatcgtgaaatttatttctgctattctgccctattgaggtcattaattataatggatttaaagatttttttttaaactctacaaacactaagccaaggaattcaggttatctgctatgttaacctaataaagcaaaggaaaataagttgctttaatccttgcttgttaacctaataaagcaaaggaaaatatgttgctttaatccttgcttcttttctcttttggtaatagaaaaggtaaataagatgtaatgttgaactgctggtgatgatttctaaaacgactctttaaatactcctttcctatggacttatattaaagatgcattgtacacattgttttagcagatagatcaaagatatactcagtggtcatctgttgcattatcagaaatttgatacatgttacagaagcatgaggaagggaatcctatccacttttgaaaatagagttcacattgcaagcgacatagggcattatcaaaaccaattcagagcctggcacaaaatgtatacttcctagtgaaagctgtctcaaaacacagcctttttgatggatcatattagctcatatctgccatagaaaggcaatcaagcttactccctgcaatcggagtcaatatcaattcttgctcaagcaaacatgttttacagtgttggcgcaatggcaggaactagtcaagggcactttcagatctggaaagaggaaagaggaggtagaaaatcactcttttgtgtttcttaaactgtcaatcaagcaagaaaatttattccaccccttcatatttgctctaaaatctggggccagtagttgaaatgtgatcttgttctttctcagccttttggcaatttaatgccaaatattccaaatgttagatgaatggcagtaataaaatgattcaaatgtttgataaatacaagctgagagcaaaatctggactctgaaaaatcggaactattttatcatgttgctaaaatgagagcatcattttcttccctctctgtaagtgcggtagtttaatttcctagaaaaagttgctagtgccttgtttaagatgatcatttatcatttcatgtggatattattggtctaattagaaggagaagattgattggatttactttaaagaaaattattctcctatgtctctttgaactcaggaatagaaaatgaccaagaagcacatcatcttcagatgtgatttttgccctcactggggatgtagaaccagaataggtacaacatatgctcagaagagaggtgacttcagtattagccttctagaaactaacatcactttaatttttacatgttccaaaaaaaatcatagtgattgttctgtaataagaatgttaacgtgatgcctatagaagttagaggtttttgtttctgtttctcttcaggcaagtccatagatagaggaaaatcagacacaggctggtgacaactggtatagatacagtgagcatggaatgagaaccacctacaacattgcctgattatttttaagtttatatcaaaactgcttcacaagttcacaaaagttgtcactcttaatttgggttaagaaaagtaatagtattatctctgctgaagttgattgtttttctcttttaccatgactgttggccaaaagcaagctgaacctctgcactttgaaacaaagcacagtatgaatctttaacccaagcacttagtttcaccactgagattctacatcatctgcaagaaaatgcacaaacttttggtccaatgttggattcttcaaaagtgcatagcaaaacttttgtgctatgccgcttgatgtaacttttaaagatgttatcaaatgttaaatgcctcattctgcgttaatttgctgttggctgttttgtgaacacaaaataaacttgagatttttttttttttttttttttgtgaaactcctccaaagccaatttcagcccttggtaagcttgcagacagttactgatcttaaatttaattttaaaagacaatgtatcttaattataatttagctttttaaaacaatgagatagctttacatttcccctttgtttgaatgagaaaatggatcttgggttgctatgctagaacacttgtagattgctgggtcctttgtaagggggccatggacacaccacactttctttcaatccttacatttgaagcattgatattcttcaaaaccttcttgttacatgtgcgcaatagaaatttctaatgttcatgacttttatctttcctgtccatcaattcactggttgtaaatgcttcctgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataagaaaaaatatatagctattattacagaagtgaatatgttgtgctctcttactgctcttggtgcattgacagtttctgtatctcaaccctattcatctttatgaaaaagcattctgaagatctatcctcagcactgctgagtgtgcagtcacactttcctaccaacccccttcttaccatctctagctgccatttgtggggggaacaaaacaagggaatcctgattgtgtacagtataaattgtattatattttttgtacttatgttttatgtaaatagtttgtctcattcaattgtatgtgagcattgaaataaatcctaccatttaggggacaattta

SEQ ID NO: 18655 - DNA, 605 bp, Homo sapiens
  ENST00000514923
acagcctggagcaggaggaccgcacacaccacacaaagccacatgggagtcccgcggcagaagagttgaacatcacagggctgtgggaggcaggccttacagtggaaggaaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgca

SEQ ID NO: 18656 - DNA, 935 bp, Homo sapiens
  ENST00000513968
attcatacacacacacgacctgggatatgactagaaaaatatgctgctctaagccctccaagctctcctctatctccacaaagtgtaaccttaaagcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgca

SEQ ID NO: 18657 - DNA, 538 bp, Homo sapiens
  ENST00000509486
gcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggtctgaggaagacaattgggctgtggaatgggagtgtgatgaagctaccaaaaaggcctgttacagcaaaggcaaatcaaaggtaagaagaatgcaattatgagcagccatcaccctgtcttgaaggactctacactatataaagcatgttgatatgaagagtattcctgattacggtgccatgtaaagtg

SEQ ID NO: 18658 - DNA, 1542 bp, Homo sapiens
  ENST00000451541
cccgttcctgcaccagccccgcaccctccccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctc

SEQ ID NO: 18659 - DNA, 4792 bp, Homo sapiens
  ENST00000357599
aactcctcccccaccgccccctccctccttctgctcccgcggtctcctcctccctgctctctccgagcgccgggtcgggagctagttggagcgcgggggttggtgccagagcccagctccgccgagccgggcgggtcggcagcgcatccagcggctgctgggagcccgagcgcagcgggcgcgggcccgggtggggactgcaccggagcgctgagagctggaggccgttcctgcgcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctc

SEQ ID NO: 18660 - DNA, 4733 bp, Homo sapiens
  ENST00000475244
caattcggcctcgctccttgtgattgcgctaaaccttccgtcctcagctgagaacgctccaccacctccccggatcgctcatctcttggctgccctcccactgttcctgatgttattttactccccgtatcccctactcgttcttcacaattctgtaggtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcaggtaaaagaaaccggacctacctcatgctgcggtcctcccagccctccggcaccccactccaaagtctggactctttccacatcctgctccagacagccaagctttgttggggtccccactgctttgagatgggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctc

SEQ ID NO: 18661 - DNA, 3791 bp, Homo sapiens
  ENST00000393583
agtgcttttgtctggtgctgggagtgaggctcagcagtgtgagggacaattggagatgctcgggggcaggctgccgcgttgtgtcctgcttttctgcggccagaccaagccgtctggagctgctggtcaggttttcttgctgacctcacctgaccacagtggcctgggtggactctacagggaaatgttgttttctccctgggagcagtagcagcagtcctggctcccctggactgagaactcctcatcagccccaggaagcccggaccccctttcagggatctggaaccggtgtgcctgtggccccaggtctgctcccaggcgtgggctgaagtcctgacttctgtcgctgggggcaaggagtgggagagcccagctgctgcctgggctttggcagacagcaggctgatggtgctggcttccccgagactgcttctcctgcctgctgtctgatttccctgcatggtgcccgcagctgagctgctacggtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccg

SEQ ID NO: 18662 - DNA, 612 bp, Homo sapiens
  ENST00000465147
ctcctccctgctctctccgagcgccgggtcgggagctagttggagcgcgggggttggtgccagagcccagctccgccgagccgggcgggtcggcagcgcatccagcggctgctgggagcccgagcgcagcgggcgcgggcccgggtggggactgcaccggagcgctgagagctggaggccgttcctgcgcggccgccccattcccagaccggccgccagcccatctggttagctcccgccgctccgcgccgcccgggagtcgggagccgcggggaaccgggcacctgcacccgcctctgggaggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggtaac

SEQ ID NO: 18663 - DNA, 716 bp, Homo sapiens
  ENST00000421053
gcggccgccccattcccagaccggccgccagcccatctggttagctcccgccgctccgcgccgcccgggagtcgggagccgcggggaaccgggcacctgcacccgcctctgggagccagcttgggtccgggttgcactgggccctgccagggctgtggtcggcgcatctgggctgcagcggcgatggggacccgggacccaggcctggagaaggagacggacgagtgaggctgagggacggagggacagagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagcca

SEQ ID NO: 18664 - DNA, 543 bp, Homo sapiens
  ENST00000477001
gcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggcaggaagccaagtggagactttgaatggaggcaaggatggaggggacctggggaagaggactggcctgaatcaccttccccaaaggtcctcatggactgagctggaggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgag

SEQ ID NO: 18665 - DNA, 558 bp, Homo sapiens
  ENST00000449546
agacatccgtgttccctggctcaggggctcatcgtccttccttcctctgccaaggctgaggcgcagctggacaggggagcatccatcacactcctttcccgccagccagcagcggcagctctcctggcaggcaggggatcagctgtgcctctccttactccactgctcctcacccctggacccagggcccaccctccatctctccttgtctggtgctgcccacgtctgcctgcagaccacacctgtgagcacttgactaagtcttctgtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcc

SEQ ID NO: 18666 - DNA, 4579 bp, Homo sapiens
  ENST00000451055
gtataaaccacatgctgcatctgtcagcagaggaagccattggctgcgtgagggtcagaaggagcttcatagatgagctggcatttgggagagggcattctacagggacgggcaagcagaagcgaagggatcgagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 18667 - DNA, 4933 bp, Homo sapiens
  ENST00000616742
agtgcttttgtctggtgctgggagtgaggctcagcagtgtgagggacaattggagatgctcgggggcaggctgccgcgttgtgtcctgcttttctgcggccagaccaagccgtctggagctgctggtcaggttttcttgctgacctcacctgaccacagtggcctgggtggactctacagggaaatgttgttttctccctgggagcagtagcagcagtcctggctcccctggactgagaactcctcatcagccccaggaagcccggaccccctttcagggatctggaaccggtgtgcctgtggccccaggtctgctcccaggcgtgggctgaagtcctgacttctgtcgctgggggcaaggagtgggagagcccagctgctgcctgggctttggcagacagcaggctgatggtgctggcttccccgagactgcttctcctgcctgctgtctgatttccctgcatggtgcccgcagctgagctgctacggtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 18668 - DNA, 4523 bp, Homo sapiens
  ENST00000195173
aactcctcccccaccgccccctccctccttctgctcccgcggtctcctcctccctgctctctccgagcgccgggtcgggagctagttggagcgcgggggttggtgccagagcccagctccgccgagccgggcgggtcggcagcgcatccagcggctgctgggagcccgagcgcagcgggcgcgggcccgggtggggactgcaccggagcgctgagagctggaggccgttcctgcgcggccgccccattcccagaccggccgccagcccatctggttagctcccgccgctccgcgccgcccgggagtcgggagccgcggggaaccgggcacctgcacccgcctctgggaggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 18669 - DNA, 6878 bp, Homo sapiens
  ENST00000343348
gggtcggaggagacgccagccaaagtaggcggagttgcggaaggagagtccgatctgcgcaatccagtccgggacttggctccgcccgggagcggcggcctctccggtgacagaggagtagtgagcggcacggggtgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcacccctgccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaa

SEQ ID NO: 18670 - DNA, 4256 bp, Homo sapiens
  ENST00000257414
gaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgacatttcaactcctctaccagataatgaaatgtcttacaacacagtgtatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaat

SEQ ID NO: 18671 - DNA, 3640 bp, Homo sapiens
  ENST00000513137
tatttctaattatttgcttatgctgggcactgaattttctcttaggctgaccatatattttattaaagtagtcttgaattcaggagtggaaaaaaaaaagttatgttttagacctcaatgtaagctgaaaggaaataaaggaacttctatatttccatttctcaggctgattttccttcccctgttctcttatctgtatcatgacatgagatgtgaacctcagaaatgtaaaaacaaaaagtctagaataaagcattccttgaattttaaatgaacatgcttttagcagctggatacgaagcagactattttcaacaaattgaatgtttcccacttgtgtgagagccaaacaagtgccatacagaaagggacctcttcaatgttaccaaagctttgtggcagcatttaagtgtggtggctccatagaagtcactatagcatggacgagccacttggcttgctttttcctgctaatcaaagttttaagaagataaaaagctatctttgttatatatgttttgtctaatttgcaatattacagtctcctggggggaaatccaacttccaataataattgtaaaaaaaaaaaaagaatgcactgtacttattcttttaatctgtctttctagaggccaatattttatttatcatgtgcatggtgatcatacttcaaggctggagcttttggagttgttgtgagtctgccctactttccaccaaaggcaccaattatacatgcacagtagttgcccttgtatcttttaaaaattgttcaagaggttgttctgtgtaagccaataactccacttgaaaatcacgaggaggtcatattttatttctgccagagagaacaggtatcattgtgccagcttggatcaaagcacctgatacaatctgtatttaaccttgtggaatgatggagggagagcttacaaacgaattcacaggaaatggctagagtttctgctgtaactctcaacctagccattcttctcatattatcctatggtagcttatctgaacctcagaaatctatccttttctaatttgaatcattttagtcaacgcagcctcagaaacggaaaccatctattgaaataatacacaaaagggacagccgtaatagcgtgtagccgttgaagcctccattccaatgaaaagacagtgggaatagatccctttggaaaccactaactaatcccagaaagaggaatgcctgtgaagttgagttgaacctgaagactagacacactgtagaacctccataggaagggtgcagagtaactgagttacttgtgatagggacaagacttacccactaccagaaacctgccccatcggtcacaaatgggattcccagagtggacactttctgtgtttagtgctgccatgggaatatcaaagaaggacactggcctttcttgagcacctatgtgtcagacactgtgcaagatgctttcaccattatgtcactatcctcccaacaccgagaggtatctttatccccactgggtgcacaggaagaggttaagtgattccctgaggcccacccagcaagtatgagagataggatctggcccttcattttctaactacaagttcaatgggctttctgctgaacacaccccacaccaccaccaccaccaccaccaccaccaccactaagccgtgtcatttctagggccatctcctctcagtcttacagccagcttgggtgtcccacctccaggcctctgcgcaaagggaatgtgggtctctctggtgatgttttcctaactgtatttgtgatgaaaacagggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatc

SEQ ID NO: 18672 - DNA, 2116 bp, Homo sapiens
  ENST00000515129
catatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatc

SEQ ID NO: 18673 - DNA, 1678 bp, Homo sapiens
  ENST00000503865
aattgaagggaggaggacccttaggaaggaaagaaaaagagaatgtacttttcaggctaaggtttctgggttttaaaaccatcacttcagaaatcaaaatattttagcagaaaaacccccatgagaaagcttcaaggtctcggctgtgacaaagacaacatttcagtagaagtttaaggttgcgtgttgtgggcttgggaaggggtagagatctttatttcctttcattctaattctgtgccactgatacctgccagtaaaatacatgaaacatattccagaaagagttgatttagtagatgaaaaatgcgtctcccgagaccagagaaggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacaca

SEQ ID NO: 18674 - DNA, 3292 bp, Homo sapiens
  ENST00000510263
aatgcgttactgtgtggactgagttcccatgactcgggctccccaggacaatgtctctttcttcaccaagctgatggtaaatatctggttagcttcatctatttaaaaccagccaagcaggaatcctagtgctggagagaggattctttttttttttgtttggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataa

SEQ ID NO: 18675 - DNA, 749 bp, Homo sapiens
  ENST00000506114
aggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgt

SEQ ID NO: 18676 - DNA, 572 bp, Homo sapiens
  ENST00000514316
tatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaagtaagtggaatatttggttctttcttagtaattatttgttatgctattatggcccctttcattcagagaaaatcatgaccgactgaggttttatgcatttttagatgactttttagtgctgtttgtaaaaatttaacacctaaaaagcattattttctccttgccaatgtgtgtgtgtgtgtttatatagatacatatatgtgtgtgtgtttatatagatacatatacatgtgtgtgtttacgtgtgtgcaagagcagaagggtttgtttgtttca

SEQ ID NO: 18677 - DNA, 598 bp, Homo sapiens
  ENST00000503402
gactttatgtggctcggagctgattccctgaaggatttatgactctgtattaaatgccacagccttatcttttaaaacatgctactctaatgctgagttttcctctttttttcttttctttcttttttttttttgttactgattttagaaacagtattaagcaccttgttgttttgtttctgttttcaaggaatgcagattctactaagatctccttgcaaaatgaatgcatttaattttccctatgtgtttttcctctgcaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacg

SEQ ID NO: 18678 - DNA, 537 bp, Homo sapiens
  ENST00000510024
agatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacaggtaatcatgccctagctgtgttgacctcatcaattcttcctggcttccttctcccagggggttctcttctaataaaccatatttgcaactgactgaaaattgcattca

SEQ ID NO: 18679 - DNA, 710 bp, Homo sapiens
  ENST00000502996
aatgccttcaacccttcctgcagaaactataaggagctgctgctgtgaagtctaagatttgatgactgcttcaagggttagttttcacttcttggaaagaggaagtcaccatggcttttgcctctggacctttccaacctcacaaaccgaaacatttgtacttcactacttcttgcctttgaccagctatagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacag

SEQ ID NO: 18680 - DNA, 767 bp, Homo sapiens
  ENST00000503962
agctctacagaagatgaaaagaaaactgtggaagaaaagagcaccttcatgcaaagggttcactagcgagttgagccctgagaaagagagacaaatcaaaaattgtgacacttagaaatataaatccaggcttataattatctagaaatgaaagtgtaacttgatgaaccttaaggagcactcttctatcatatttcctaaaataacagactcatatggaaatggaaaatggtggcatgatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccg

SEQ ID NO: 18681 - DNA, 563 bp, Homo sapiens
  ENST00000515009
gactcgggctccccaggacaatgtctctttcttcaccaagctgatgggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcag

SEQ ID NO: 18682 - DNA, 538 bp, Homo sapiens
  ENST00000509665
aacaaataaggcaggaatgggctgtatctgctgttgaccatctcaacgcccaagcctgcctttcctggcttagggaggaggccctgttggggaactgagctttctccatagccagagatttttggttccagggcttcttgacatgaaactcccaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataag

SEQ ID NO: 18683 - DNA, 582 bp, Homo sapiens
  ENST00000512156
taccagttcgctccgagccccggccgcctgtccgtcgatgcaccgaaaagagaacctgtgtgctgtggaaggtccccaggctacagggtgcagagatgtccactgggcacatgctgacagatccttcaaaaaatggtacttaaagaagattagatcaacatttctgagaaaagcatctcttttgccttctcattggttcagtaaacccagttaaaggcaaagtttccagccctcagagcctgccatgggattcctgtatcattagatattgttaacattagcacttttggagtattatttcacagacatggtttcaatgttcagaaccaaaaggtggagaaatggtgtcagataaccttagagaggatcattttcttggtaatctctcctttcttaaaataaactagatattgctgacaatgtgaaatttgtgactaaccttcagtagatatgttgattttgcttttaaaataaaaaccaaggatgcttagaagtagccataagaggaaatattttgaaaatgaatgacctaaagtaatcaatggatatgtataacatttatattttaaaatgacaatgact

SEQ ID NO: 18684 - DNA, 6028 bp, Homo sapiens
  ENST00000558014
gtaaccggtggaagtgtcaaagaggaaggagtggagggctgctgaggtgacagggtgtggtctgtgagggagcggacgaacccggagaagagagcagagagacccaccaggactaggaggcagcggggagcgtgcctgcgtcgctcggagcggtgacagcaaggagcgcagcgcggaggccgggcggcaaggggagtttccagtcctcgataagtggagtccctgctctgcgctgcgccagcgccttccgcctgggcccgcggtgctagacacctgccgagtccgaagcgggagtcaggctgagccttcggcccccaagatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcatta

SEQ ID NO: 18685 - DNA, 545 bp, Homo sapiens
  ENST00000559184
gcatgctaacattcatggaggcagacatgtgtacccagaatcagagggagccggttatcctcagttggagatcccaaaagacttctgcatacagttcctttcgttggatggagacactgtaagaaccacggagtgttaaacttggggcttgggaatcagagtccatccttgaatttcacaaaagaaacgaccgaaatcaaaagaaggcaagatacagctgttcgcatttgcagacctgtatgatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagc

SEQ ID NO: 18686 - DNA, 479 bp, Homo sapiens
  ENST00000560636
aggactgggtttggagagctgctggatagctgaacacgtggaggttcctggaaggcggcacacccagagagagcatggtagctccatgctgcttcccccatacctcaccctacacatctcttcatctgtatcctttataataatccactaaatgatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggaacttccaatcctgctttagaacttactccttcaggaaagcaactctcactgaagtgtgggagcggagcagagaaaagactaggtagctcagtggcatttctgagcaggggccaccctgacttcaccttggcccaccatga

SEQ ID NO: 18687 - DNA, 588 bp, Homo sapiens
  ENST00000561133
aaggcagaacttcacggaacaactgcgcccgcagctctcctgggctgcagtgatttgtcctctgggttctggaggaaagctctgaaagaagtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactac

SEQ ID NO: 18688 - DNA, 3754 bp, Homo sapiens
  ENST00000536845
cgtccgtgcccgggggtgggacccgcgccgggagctgccgagtgcgtggagggagccaggctccggctcgcctgatggattgacttggagatggatcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcag

SEQ ID NO: 18689 - DNA, 530 bp, Homo sapiens
  ENST00000561106
gagtgcgtggagggagccaggctccggctcgcctgatggattgacttggagatggatcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactgtaagtcgtctcaagaacagtcttctattctgagaaggaagcttttctgtttttcattctgtaagcatgttcattt

SEQ ID NO: 18690 - DNA, 4419 bp, Homo sapiens
  ENST00000558816
atcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaa

SEQ ID NO: 18691 - DNA, 2318 bp, Homo sapiens
  ENST00000389425
atccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtaggtatatgttacgagaacgcccttcagcactgctcaaaaattttcggcatgtatttcatctagtcatgtccttttggtcctctaaattagcagtggtttggcataatagtgttttgtgttttttttctcattgaaataaatcttgggtttgtttttttcccgagcctgctagggcgaggggggtgaatggttgatgagtttaaaaataatgcagcccttgtttttcacctgtagaatatgagaacattttaacagcacctctcttatcttgcagatatattccaagatgctacatgcagcagacagctgtgagcttgcatacacacacacacaaatatacatgcacatacatacacagaatgcagtactagttaagtatttccttcctatctttaataagtaagagaatatttagaccatt

SEQ ID NO: 18692 - DNA, 6099 bp, Homo sapiens
  ENST00000316364
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 18693 - DNA, 5931 bp, Homo sapiens
  ENST00000354744
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 18694 - DNA, 5913 bp, Homo sapiens
  ENST00000358066
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 18695 - DNA, 5874 bp, Homo sapiens
  ENST00000389428
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 18696 - DNA, 734 bp, Homo sapiens
  ENST00000559196
ccaaactgcttctgttttccaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaag

SEQ ID NO: 18697 - DNA, 595 bp, Homo sapiens
  ENST00000558431
acttgactgactaaacatatggcttcaaaatgtatcccacaaaataggtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctggttagttttttttaatttttttgaattaacaaccttttctttccttcagttcagcattttcagccccttctcccctccttttgcgcagtttggcagcccttcatttttccgctttgactcatattcccactgatggtaccaaaagacttttcttactgagcacttcacccttgtttatagcatgttaacacttcatcattgaccaagcca

SEQ ID NO: 18698 - DNA, 580 bp, Homo sapiens
  ENST00000559064
gctgttaaccgaagacttctttgctttccataaccacagtgctgaaggatatgaacaagacacagaattcggcaacacagctcatctaggggactgccatgaaattttgcctacttcaactacaccagattacaaaatatttggcggtccaacatctggttagttttttttaatttttttgaattaacaaccttttctttccttcagttcagcattttcagccccttctcccctccttttgcgcagtttggcagcccttcatttttccgctttgactcatattcccactgatggtaccaaaagacttttcttactgagcacttcacccttgtttatagcatgttaacacttcatcattgaccaagccacatcctttaagaaaattcaaatgggctaacatagactgcattccagctgcacgcacgcccacccaagctttcttctttctcacctctttgcattgtgaatgtttcttctggtcatctgtatttaatggatggcggaatttcattattttccccatctctcctcacctttcctatgacctagtaaacaaatacacatttcccataaatgtgta

SEQ ID NO: 18699 - DNA, 592 bp, Homo sapiens
  ENST00000560006
gttaaccgaagacttctttgctttccataaccacagtgctgaaggatatgaacaagacacagaattcggcaacacagctcatctaggggactgccatgaaattttgcctacttcaactacaccagattacaaaatatttggcggtccaacatctgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattct

SEQ ID NO: 18700 - DNA, 5908 bp, Homo sapiens
  ENST00000355997
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattat

SEQ ID NO: 18701 - DNA, 5496 bp, Homo sapiens
  ENST00000382103
attctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaagggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttggaagtcaatgactattttgagatgaagtatttaactatgaatatcatgaaggttatttaaaaatgtatttattttatctttggggttcaaacattaaaaaaatttacataggtgtagtaactcatttcaagggaataaatgctggattaaaaagtgtaaatttttcatgagaatttgggactaaattgctgaaccaataaagctgaagagttgcaacctctagagtcaaaaaagggattgaaatgttgttgcaaatgtaaatgctggcagtgcagcttgctatacatgtaagccaaaattgttttatagaacaagtgatctatattgttgtgatcatcatttagcttaagaaaggccagagctgggagagtagcaaatgttttctcatctgcagtgtatcagcagttcttgggcttcagctgctgaatagataataattctaattgaacataaattacatgaactcacatgtgaatgatagatatgttacaatatttcattcctgatgcagaaaatcagctgtggtttttattattaaccctttctttttcagtggttttggaattctagctctattcctcctggcttaaaatttgagggcatagaattcacaagagtttttgaagagttctgtctattcaggctttcctttgtccccaccctagtgtcattttcactcactcccatttctacacataagtattaaaaaggatgtatttattataattcgctagtactgattggtaagcctcataattggcctttgttatctttgtactgtgacgaaggcagtggatgatacattaccaatcattgccgaagataacctcttctatctttttgacccaactacccttattaaaactatcaggtaaaatattggagttaggtttttaaagtcattgggctgtggcagtgtgcttagaaaagaaaatggtggaacatagaatattcttttggtcactacacaatgtgttacttatacatggcagggaagggaattttaaatcaaactcgcagtttggttcttaggtcctctgctgatgaattctcgctctatcagggaatgatatgtgacgccagccttaggaacctggtgttcaactgtaaatctttctatttagctttttgtattagttgaatgaagttatagaatatgaattattgaatacagttctgttcagccaataggcacttgatatacagaatggtaaatttaaatataaattaaatttttctaatattatgatcagcacttcactgtggttctgtgtctttaaccacctcataataagaactgttattgaggactgggctacagaatgtgcttagactacatctatggcttccatagattttagtaaaatttaaacagataatttgtgtttactgctgatgttactttaatattgaattagtagttcatcctgagagttatatttcacagaggaaaataaccaacagctgaaaacaacaataataaagctctggtgagtctgactcatactcggagaaagtttttggaatacatacacatttggtgcatataagagttgggtttccttttcccactttctgagatgtactaacctctgccagacccttaaatgattttgttatgttttgcatttttgaggccaaccttattttgtaactgaaaaaagtccagttttgcatacacagaaatttggtcattttagaagtctcacaacctgaataatttgataataattgaatatgctattaacagctttttaagaaaaggttctattagtcagttttttccttgtctgtcatattatgttggttaatgtctcttatggccaatcttagtaaacagacctaacactcactgcatccttttgtgccttactttttactttccttttgcccttttggtatgtgcgcatgtaagatggtaagtttaaggctaatgaatatatgtttgtaatttcctactcactactctgcagttaaagctaaggccttaggcaaaatctagaaatgtttatattgttttgttttttatcaagtggtgtcaacttgagaaatacaaagaaaggctatgcttaactgtataaccgtgggggattttagccatgagaatatgaagctgatgtcagcctgctaacctgttttaccaaaaggaaaagatgtttccaaaaatgttttcggtgtagactgtttaaagatgaaaataaattatataatttattatatgaaataaatttttgataagtca

SEQ ID NO: 18702 - DNA, 3344 bp, Homo sapiens
  ENST00000358971
attcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaagagtctcgctctttcgcccaggctggaatgcagtgtgacgatctcggctcactgcagcctccgcctcccgggttcacgccattcgcctgcctcagcctcccgagtagctgggactacaggcgcccgccaccacacccgggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttgg

SEQ ID NO: 18703 - DNA, 1494 bp, Homo sapiens
  ENST00000514585
gtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttga

SEQ ID NO: 18704 - DNA, 544 bp, Homo sapiens
  ENST00000503150
aaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgataggaagagcttcagcttcaccttctttagatgtccttattactttattgtcacttggatcaaatggctataagaagctactaaaagaaagaaagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaag

SEQ ID NO: 18705 - DNA, 529 bp, Homo sapiens
  ENST00000515272
acaatgaaagactgttgcatacacctcacaatcccatatctttagctatgacacttaaaacactagatgaacaccgtgacaaagctgtcactcagcttggctcgatgctttttaccagacaggtttctggagccaggtaagtatgtttaagatagatatgggtttatttgtcttttcaaacttaactccagtaaaatacctttcctcaacaatagtcccccaagtatatcctgaactatacctgcgaattcatcatggagtaaagaatgatgagttagagaatctgtaaggctactgtatgcccacctgtggactgcttatgcctgaaatagtcacaaaaagacatgaatcttgtttgttttcatagatgtacagaaccaaagttttattacctctctacatagatttttttctttatttcctttgttagatgatcttcagcaagtcacattatggtattagagataagccatcttcatcactaaattgaagtgaaagtgttcttaaggaaaagccttcttcctaaact

SEQ ID NO: 18706 - DNA, 420 bp, Homo sapiens
  ENST00000505513
atagcatgcttcctagagtttcaggatcttcccttattttagttcacactaacattttgttttctggttggtttggttaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgataggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttag

SEQ ID NO: 18707 - DNA, 561 bp, Homo sapiens
  ENST00000513285
gcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaagagtctcgctctttcgcccaggctggaatgcagtgtgacgatctcggctcactgcagcctccgcctcccgggttcacgccattcgcctgcctcagcctcccgagtagctgggactacaggcgcccgccaccacacccggttaatgtttgtatttttagtagagatggggtttcaccatgttggccaggctgatctcaaactcctgacttcaagtgatcggccattcttggccttccaaagtgctcggattacaggcggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggtatcttt

SEQ ID NO: 18708 - DNA, 383 bp, Homo sapiens
  ENST00000510415
ttagccccgccccgctgcggctgattcgtctagttaaaccctggtgttcctgacacaaacttcaggaaaggattttgcacttgtgcagaccgggcgagcagagtaagaagcaggtcccgcataccaacaaaactaaggacgccaacttgtctggaaggcccaataaaaagctgattcatggaggaatgcaattgtcacatcctaatgatttcatctcccttaccccaacgaatcgataaccccaaattttccagcccctcaccctccacaaatccccttaaaaaactttgcctagaaccccttgatgaaatggattgaagcttgagaactcttcctgtttcctggcttgtaacttgtgattattaaaactttctctgctgcaa

SEQ ID NO: 18709 - DNA, 4055 bp, Homo sapiens
  ENST00000507794
agttaaaccctggtgttcctgacacaaacttcaggaaaggattttgcacttgtgcagaccgggcgagcagagtaagaagcagtctcactgtgtcgcccaggctggagtgcaagtggcatgatcttggctcacaactgcaacctccgtctcccgggttcaaacgattctcctacctcagcctcccgaatatctgggattacaggtgcccaccaccatgcctggataatttttaaaaatatttttagtagagacagggtttcaccaactaggccaggctgctcttgaactcctgacctcaggtaatccacccgccttggcctcccaaaatgctgggattacaggtgtgagccaccgcgcctgaccaactttagcttttcaaaatctgtcttcgtagacgataatggaaatatctaccaaagctaaatattcacctaccccatgacccagcaattttactcctaggtatatataccaaaaaaaatgagtgttctgtgtccactagagatatgtgccaaagtgttcataatagatccaaactggaaacagctcaaatgtccatcaatagcagaaagataaacaaatgttgggatgttcagagcttgaaatatgacacaatataaaaggacaaactattaaaactcacaacagcatggataaatcttacagacataattattgagcaaaagataccagaaacacaaaagtatatactgtctgattcctttaaataaaggttaagatgattctccctcctgcagccttgtgaagaaggtgcctttcttccccttcgccttctgccatgattgtaagtttcctgaggcctccccagccatgttgaattctcattgtccctgataaaatagcaccctctcttcctctgctcttccacccttttcctcttccgctgtgcaactgaagactgggaaagaatgacatgcaaaataagaggttttggattcagcgtaggactaactactggatgctacttacagaaaactttatatttgtgctgaaaaatcttgttatctaggtgaaagccaatgctatcctaatgacaaaattgttggggaaataaatttataagagactttatttaaagaaataaaagaaaaaataataaagcttaagacaaaaaactaatccattttggtagacatcagcacttacctctgagaaggaaaatggttactgatggggaagtgggaggcataagggaatcttctgggtgatgaaaatgttctatttcttgatctgaattgtagttacttgggtttagacatatgcttaaaaatcgtcaagttatgtgtttaaaacatgtgcaccttacagtatataagccacacttcaatttttttaaaggtccccacaacattgttgttttcaaggaagtacaggaaatatcttttactctgtgttaattcagggaagttatctccataagtgctttacaaaataatcttcataatatagtagcaccattaagtaggcattattatctctgtatcacaaatgcacaatatgagagtcagagaggttaagttattttccaaagtcacacagctaatcaatggcaaagttaggattttttttttcttttttgagacagagtcttgctctgtcacccaggctggagtgcagtggtgtgatttcagctcactgcaaccttcgcctcccagcttcaagcgattctcatgcctcagcctcccaggtagctgggatttcaggtgtgcaaccaccacacccagttaatttttgtatttttggtagagatagggtttcacatgttggccaagctggtcttgaactcttgacctcaagtgatccacctgtctcagccttcccaagtgctgggattacaggtgtgagccatcacactcggccaaagctaggatttgaatataagtttgtctgaccctcaaaacccatgctccttcctctgtgttagccaacttcctgcatagccaacttcccagggtcatggaaagaatcattaacgcaacccaggaatgctctcccggagtgtggctatatctagagaaattgtggaaagaggccaggcacggtggctcactcctgtaattccagcactttgggaggccaaggtgggagaatcatctgaggccaagagttcaagaccaacttggacaacatagtgagaaccctttctctattcaaaaaaaagaaagaaagaaagaatttgcctaaatagaacagaaaaggctgtatgtgcaagacagttactgcaggttttataatagtaaaaagctagaaaaaaactaattattcaacagtacataattaagcaaattaaaatacatatattcaataggatattaagcagccattaaaagtcatacttaagaaagcttatgatataattttcactgaggtaaaactgaataaaagttgcatgtactttaagaatacaaccacgaaaaacaaagctttttaaacttatgcacagagaaaggaaaggccagaaagtgtttgtatgtaaagaccattagtatgtgttgtctgtgatttttttcagctgtgttttgtagcttttccttgtagaggtctttcacctccttggttaggtatattcctaagtatctttttttttgcagctatcgtaaaaggggttgcattattgatttgattctcagtttggtcgctgttggtgtatagaagagctactgatttgtgtatattaattttgtatccagaaaactttcctgaattcttttatcagttataggagctttctggaggagtccttagggttttctaggtaaacaatcatatcatcagcaaacagcgacagtttgacttcttctttaccaatttggatgccctgtatttcattctcttgtctgattgctcaggccaggacttccaatactatgttgaggaggagctcatggataggtagaatcaatattgtgaaaatgaccatactgctaaaagcaatctacaaattcaacacaattcccatcaaaataccaccatcattcttcacagaattagagaaaacaattctaaaattcatatggaaccaaaaaagagcccacatatccaaagcaatactaagcaaaaagaacaaatctggaggcatcacattacctgatttcaaactatgctataaggccatagtcaccaaaacagcatggtactggtataaaaacaggcacatagaccaatggaacagaaaagagaactcagaaataaacccaaatacttacagccaattgatctttgacaaagcaaacaaaaacataaagtggggaaaggacatccttttcaacaaatggtgctgggataattggctagccacatacaggagaatgaaactggatcctcatctctcaccttatacaaaaatcaactcaagatggattaaggacttaatctaagacctgaaactacaaaaattctagaagatatcattggcaaaacccttctagacattggcttaggcaaggatttcataaccaagaacctaaaagcaaatgcaataaaaccaaagataattgctgggacttaattaaactaaggagctttctcatggcaaaaagaacagtcagcagagtaaagagacaacccacagagtgggaaaaaaccttcacaatctatatgtctgacaaaggactaatatccagaatctataaggagctcaaacaaattagcaagaaaaaaaaaatgatcccatcaaaaagtgggctaaggacatgaatagacaattcccaaaagaagatatacaaatggccaacaaacataaaaaaatgcccaacatcactaatgatcagggaaatgcaaatcaaaaccacaatgtgataccactttactcctgcaagaatggccataatctaaaaatcgaaaaatagtagatgttggcatggatgtggtgatcagggaacacttctacatggctggtgggaatgtaaactagtatagccactatggaaaacactgtggagattccttaaagaactaaaagtaaaactaccatttgatccagcaatcccactactgggtatctatcagaggaaaagaagtcattatacgaaaaa

SEQ ID NO: 18710 - DNA, 1709 bp, Homo sapiens
  ENST00000583114
gacaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagaggggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggcttctgg

SEQ ID NO: 18711 - DNA, 1906 bp, Homo sapiens
  ENST00000426861
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 18712 - DNA, 2790 bp, Homo sapiens
  ENST00000580796
gaaggaggctgacccccaaaggagaggagaatctttagggtctagagctgacaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagagggggtaaggagacaactcagggtgcttccccttatatgtccctcacagttgggggctgtcagaagctctggaggcccagcctttcccaggctcttccatcctccctcacctggtctctcccagctgcctcccacccacagtcagcatccactggcgggtttactcttctctcccagggcccagggtcagatttgggtgtggctcagtgtctggagtaaggggtaggatcaactatactgagcgctgggcagtgaaccctgggaattgagcaccagcagtagaatctgtaccccagtcccccagctcaccagtagtgacaggaggtacagaaccccctgctggttgacctgcctgatgcagtcagctttcttctcccctgcctacttccctcatgtccctgccccattctgatgcactgtactctccttttgggtttaatgcctctgtctgctctatcttaatcagtctggccttacttcctggcctgagacagtccctggctaggccagaaccccaggaaaggcagcctcaaaaaacatgctgctgagaaggagaccagaactggagttccttagttcccaagagcagttgccagggctctgggggtgcccagggctcttcctggaccctgggacccttcctggcatattggattggggaggcttgtgagcagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtttgtgtgtgtgtgtatctgggacctatttcagtcctgtgtcagccctagctccaagatatctgcccccaagggcactggaaatttgcagtttcagcaagggcaggaggcccagctggtggcctcagatgggaactcacagaagtctggcactgcttttttaaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 18713 - DNA, 2195 bp, Homo sapiens
  ENST00000582270
tttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaagtgagggaagctggtggtgggaggggatcaggtgggcttctagaaaggatgtggtccccagaactgtgggcccctcatctgtttgtcagatccgggaggagattgagcattttggaatcaagatctatcaattcccagactgtgactctgatgaggatgaggacttcaaattgcaggaccaagccctaaaggtggggccactctagggcatcccattcctatcttatttcttccgggtagaaaaagggagtagaattctatattcaggctatcagggtgggaaaggaccctggcttcctagaatgaagcagagaagatgacgatacaggtggaaagaaagaggtgagaacagagggtgctgacaggcacccctaacctcttccaggaaagcatcccatttgcagtaattggcagcaacactgtagtagaggccagagggcggcgagttcggggtcgactctacccctggggcatcgtggaaggtaaagcactgagcctgtgaccagggtatctccttgccctcagtggctctcccctacctatgcctctggctgacccctagccttgctatgcagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 18714 - DNA, 1362 bp, Homo sapiens
  ENST00000579371
gacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctggggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaaggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 18715 - DNA, 2151 bp, Homo sapiens
  ENST00000583273
aggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtttgtgtgtgtgtgtatctgggacctatttcagtcctgtgtcagccctagctccaagatatctgcccccaagggcactggaaatttgcagtttcagcaagggcaggaggcccagctggtggcctcagatgggaactcacagaagtctggcactgcttttttaaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 18716 - DNA, 1784 bp, Homo sapiens
  ENST00000317268
caggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 18717 - DNA, 1792 bp, Homo sapiens
  ENST00000577440
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 18718 - DNA, 1795 bp, Homo sapiens
  ENST00000457347
acttgcactaggaagggattgggccaggtttgcccaagtccactgggcatctttagtaaatttctctttttctcctcctattggcactctctgaattccatttgctgccccctgggaatgcctggcttctactctgttatgacagatgaggagctctccagccctgttcagcagcagagctgctccccagaagccaagaaaagaaggctcccaagcagctgggctgctggtcttctctgactctctggagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtg

SEQ ID NO: 18719 - DNA, 1396 bp, Homo sapiens
  ENST00000580844
ggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctggggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcc

SEQ ID NO: 18720 - DNA, 1530 bp, Homo sapiens
  ENST00000317256
ggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagca

SEQ ID NO: 18721 - DNA, 1597 bp, Homo sapiens
  ENST00000412945
acttgcactaggaagggattgggccaggtttgcccaagtccactgggcatctttagtaaatttctctttttctcctcctattggcactctctgaattccatttgctgccccctgggaatgcctggcttctactctgttatgacagatgaggagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagca

SEQ ID NO: 18722 - DNA, 1731 bp, Homo sapiens
  ENST00000584488
aaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaa

SEQ ID NO: 18723 - DNA, 952 bp, Homo sapiens
  ENST00000580809
gtgacggcggtgctgcgaggtcggcgcgcagctccgccgcgggtcgctcgggcgctgtccaggcggagccggccccgcccgggctgcagccatggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaagtgagggaagctggtggtgggaggggatcaggtgggcttctagaaaggatgtggtccccagaactgtgggcccctcatctgtttgtcagatccgggaggagattgagcattttggaatcaagatctatcaattcccagactgtgactctgatgaggatgaggacttcaaattgcaggaccaagccct

SEQ ID NO: 18724 - DNA, 724 bp, Homo sapiens
  ENST00000577729
ggaggcgggagggtgacggcggtgctgcgaggtcggcgcgcagctccgccgcgggtcgctcgggcgctgtccaggcggagccggccccgcccgggctgcagccatggggccagtaccaacttcatttggaaaacgcagaggaggcccacaaacactgcctgcctcaccaggagggatggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccac

SEQ ID NO: 18725 - DNA, 632 bp, Homo sapiens
  ENST00000581615
aaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacat

SEQ ID NO: 18726 - DNA, 508 bp, Homo sapiens
  ENST00000578131
gaggcgggagggtgacggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccg

SEQ ID NO: 18727 - DNA, 3544 bp, Homo sapiens
  ENST00000585170
aatcatgatgccaggacagcaggcatagactgggatgtatggtcaccactggacctcacaaatgtcataggtgagaaaagccttgggttaggcttgcctcaggatagcctcttctggtcacccagcctccatctgctggttctagttttgggctaaggggcctcttttcctcccctctgtccaggcgagcactggagactatggctataagcaggtgtgaagacttcagaggcaacagcctggcagtagctcctagcagacttttccctctaacctccctatctcaacctcttccctctggcatacacctggcagtatgcatatctgcctccctcaattcttccctttgcaggaagactgtggctatcttatcttcctcactctagctgggactccacagtggtctggggtagtccccactggcttggctaaccctcagagagtgagtcagcctctgcagccggcccttgtccattgtctgggggtggcacgtgggtattgtgaggcagagctgagcccagcactgccaggcaccccacgaaggaggctgacccccaaaggagaggagaatctttagggtctagagctgacaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagagggggtaaggagacaactcagggtgcttccccttatatgtccctcacagttgggggctgtcagaagctctggaggcccagcctttcccaggctcttccatcctccctcacctggtctctcccagctgcctcccacccacagtcagcatccactggcgggtttactcttctctcccagggcccagggtcagatttgggtgtggctcagtgtctggagtaaggggtaggatcaactatactgagcgctgggcagtgaaccctgggaattgagcaccagcagtagaatctgtaccccagtcccccagctcaccagtagtgacaggaggtacagaaccccctgctggttgacctgcctgatgcagtcagctttcttctcccctgcctacttccctcatgtccctgccccattctgatgcactgtactctccttttgggtttaatgcctctgtctgctctatcttaatcagtctggccttacttcctggcctgagacagtccctggctaggccagaaccccaggaaaggcagcctcaaaaaacatgctgctgagaaggagaccagaactggagttccttagttcccaagagcagttgccagggctctgggggtgcccagggctcttcctggaccctgggacccttcctggcatattggattggggaggcttgtgagcaggtgagggagggatggtgagcacttcctctgtcttggctgcagtttctttttcttctaaccacaagtgctttccctttccctcttgccttctcctgtcttctgtctccttcctcattcttcccttccggctcccttcccggcaccacccatctattctacccaccccgcttcccccagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtttgtgtgtgtgtgtatctgggacctatttcagtcctgtgtcagccctagctccaagatatctgcccccaagggcactggaaatttgcagtttcagcaagggcaggaggcccagctggtggcctcagatgggaactcacagaagtctggcactgcttttttaaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaaggtaaggaaaggagaggacaatcaggcagacttgccttgggaaattaaactcactccagagtctgggggatggggctctcccccacatgcaggaaaccatggcctcctagagagactgacagcagctctccataggcctaactgcctggcagcccaccagccagctccctaaagatttgggtgctgaagcagggcagagaccagagtcttgctctctgaatgagtctctgacccccaaggattccaggaatccaagaaaaaaaccgggagcagagaagaggctggggccagagccaacagccaccggcatttcctgtgttgggaaatgtactccttgctggttcccagagaacagtcccccagacagcttgggagtggagaagggggcagtgtggattaggcagtctgagcaacaaggctggttggggtgggcggttcatcctgactgggcaggtccctgcccttgccctggcctcagtttcccctttctccagagaggatcatgcaaactgtggagatcactaagcatgcagtggacatagaagagaagggtgtgaggctgcggctcaccattgtggacacaccaggttttggggatgcagtcaacaacacagagtggtatgtctgagtaagcacaatcccagctgcccctgagccacccttctccatacacaggtacacacgtaggcccagatatatccatacttatcaggaggaagcggtctatgaccttgagcatgtgacttcccttactggacagccatctcctcctttataaagtaagagggaaaggattggaatagatgatttttaatgttccttccaattctgccctatgattctataatggggtagggacataagaaagaagaggctgaggcggaagtatcacttgaggccaggagttcaaggccagcctgggcaacatagtaagatcccatctctacaaaaagttttaaaaattagctgggcatggtggcataggcctgtagtctcagctactggggagggtgaggcaggagaatcacttgagctcaggaggttgaggctgcagtgagccatgattgcactactgcactatagcctagaagacaaagcgaaaccttcc

SEQ ID NO: 18728 - DNA, 789 bp, Homo sapiens
  ENST00000583291
cgcactcggggaggcgggagggtgacggcggtgctgcgaggtcggcgcgcagctccgccgcgggtcgctcgggcgctgtccaggcggagccggccccgcccgggctgcagccatggggccagtaccaacttcatttggaaaacgcagaggaggcccacaaacactgcctgcctcaccaggagggatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtg

SEQ ID NO: 18729 - DNA, 963 bp, Homo sapiens
  ENST00000584789
aggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtttgtgtgtgtgtgtatctgggacctatttcagtcctgtgtcagccctagctccaagatatctgcccccaagggcactggaaatttgcagtttcagcaagggcaggaggcccagctggtggcctcagatgggaactcacagaagtctggcactgcttttttaaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagt

SEQ ID NO: 18730 - DNA, 235 bp, Homo sapiens
  ENST00000581921
aaggctcccaagcagctgggctgctggtcttctctgactctctggaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtgg

SEQ ID NO: 18731 - DNA, 559 bp, Homo sapiens
  ENST00000584528
gaggcgggagggtgacggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtg

SEQ ID NO: 18732 - DNA, 566 bp, Homo sapiens
  ENST00000580791
ctttagggtctagagctgacaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagaggggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggctggggcaaaggcctgaaagggagagaagattggcgctgggtgccggggcccctttggctcctcaccgtgatgcattctgccttcctgtctacta

SEQ ID NO: 18733 - DNA, 604 bp, Homo sapiens
  ENST00000582248
aaaggagaggagaatctttagggtctagagctgacaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagaggggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtttgtgtgtgtg

SEQ ID NO: 18734 - DNA, 549 bp, Homo sapiens
  ENST00000580740
agtgcagcccggggacgaggagctgaggctccccgctctgtcctgggtgactctgcatactctgcgcatccgggggtcgcgggctgcgaggccggcccccagctgggcaccccgacccacttcgcgccggcaccgctagcagctgagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtg

SEQ ID NO: 18735 - DNA, 564 bp, Homo sapiens
  ENST00000578747
atcagtaataagcggaggtgagggtccccatcctcgcctgggtcagcttttacctgagtaacccctcctcacccacctaccctgggcacaggggccagtaccaacttcatttggaaaacgcagaggaggcccacaaacactgcctgcctcaccaggagggatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgt

SEQ ID NO: 18736 - DNA, 676 bp, Homo sapiens
  ENST00000581607
gggcgggcgcggggcagggctggggtgcgcagggccggtcgctcccgggcggctgcaaggggacccgcggcaccgcagccgcggctgtgcagggtgggaggcgccgtcgccggccccgggcacaggctggcactgctgccgggcggcggtgcgtcgctgctcccaagtttttccctctgagcagccacggagtgggcgccaacccctgggtgatgcctgcgctctaggacgaaggggtgggtccgtgctgagggaggtgcccgctggtggagacgcgcttgttgggctggggaaggcgcatcagtaataagcggaggtgagggtccccatcctcgcctgggtcagcttttacctgagtaacccctcctcacccacctaccctgggcacaggggccagtaccaacttcatttggaaaacgcagaggaggcccacaaacactgcctgcctcaccaggagggatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagt

SEQ ID NO: 18737 - DNA, 1707 bp, Homo sapiens
  ENST00000582976
cgcagaggaggcccacaaacactgcctgcctcaccaggagggatggtaagacgcttggcccctccttccctcagcctgacaaggggcagtccctggccctttcccaaagggaccccagagagggggaggcccagcccaccatcctgcccggtgggattagctatatccttctgcccctgggacaggaaccatgggaaagcttcctcctgctgcatctacccgctccctccccaccagccaggtccctctgcagtgtgtgggggtgggggcacccatccctgccacctgcctgtagtgggaagagaaacagtaaccccagccagcctccctggaggtgcccaggtaggaagtttttgatgcttggctctgaagatgtaatctcttctcctgacattgttgccagagcctgccacaaataacgtaagggtgtcaggacctctaggccacacaccgtcctctcctctcagtctggaagccccacagcctttgccctctgcattgggggacacaaactgtttacagcagggggggatcactgaccagcctgtggggcgggatgttggctgtgggcagcctccagaagggagctccctgggccccctgggatcagaagctttcaggtttggtagggccaaccttttgggctcttgtctctcaagctgtgtccaggcagaggcccaagccttggccaggaagtcttggtgaccctgtgaccttcccccaacgggggttcctgagagaggcctgtccttattcctttcccccacttctccccacatggtggatggatggactgattgttctagggatggaagcctagggaagcactgattgtccccagtgccaagcccagcaggggctagaggggctttttctgccacacactaacttcagttcagctgaggtcttggtgctttcggcttgtccgaggccacactgttcttctctaattaaagacacacccccctccaccccaaccaccatcaccaaagtccccatcctcaggcccctgccctcaagccagccaagttcttaggctgactggttcagatcagactcctctatgagggtctctttgtcaaaggaggtcagtgtcctagctgctttgggaatcagtgggggagacccccccaacccagctatgccagggggtttaaatttacatgtgaaaagaatgacaggccaacattaatgaccatcctgtgacttgggatgcaccttctcttctcaggttcaaagcagcttaaggtatctatcatctgggagtgctttctctccccagcctcgctgggaggcaaggaagggccattcacaactgaacattaaggtcctcaaattaagacactatccagactcacaaaagatgtttccacccaaccagaaacagtggacccctgacccctagttgagtgcacacttccaaccaggccccttaatttatctcccacctaaatggcagctctgaagcttctgggctgccagcctcccattgccttgaacccgtgctcctcagagaccaagtgctaacagctcccctgttgacactatggaagccatggagtgatctaattgatacaggttgctataagtcagaggtcaggtgtcctagggtaaggggagtccctggagcaaagtcttctctgtggctgatgctccctgcagggaaatttaggagcagatttctgaaacagtgacgttcctcacagg

SEQ ID NO: 18738 - DNA, 1556 bp, Homo sapiens
  ENST00000393086
atgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggcttctgg

SEQ ID NO: 18739 - DNA, 509 bp, Homo sapiens
  ENST00000635172
aagtcatgctcgaaatggagcgaggcggcggagctggggaggcggtaatctcgcgagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattct

SEQ ID NO: 18740 - DNA, 506 bp, Homo sapiens
  ENST00000635476
aagtcatgctcgaaatggagcgaggcggcggagctggggaggcggtaatctcgcgagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattct

SEQ ID NO: 18741 - DNA, 4399 bp, Homo sapiens
  ENST00000399034
aagtcatgctcgaaatggagcgaggcggcggagctggggaggcggtaatctcgcgagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttc

SEQ ID NO: 18742 - DNA, 1584 bp, Homo sapiens
  ENST00000435235
gacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagag

SEQ ID NO: 18743 - DNA, 583 bp, Homo sapiens
  ENST00000634600
gtcagtgcgagatccgctgctgctgaggagaggagcgtcaacagcagcaccatggaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcaca

SEQ ID NO: 18744 - DNA, 569 bp, Homo sapiens
  ENST00000635669
cagtgcgagatccgctgctgctgaggagaggagcgtcaacagcagcaccatggtgtttcaatggatttgcctctcctgtttggactgaatatgtcattacaattcttggaattctttgtttactgttcctctgtggatttcttctgttggaatctggaacactggaatgatggaaatgtgttctttacaaagtagctcaacagaagaaccttgaaggctatgtgggatttgccaatctcccaaatcaagtatacagaaaatcggtgaagagaggttttgaattcacgcttatggtagtggaggtgatgtttcaccatgttgcccgtggctaatcttgaactcctgggctcaagcgatccatccgccttggcctcccaaagtgctaggattacaggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgatacccc

SEQ ID NO: 18745 - DNA, 643 bp, Homo sapiens
  ENST00000493626
agtgcgagatccgctgctgctgaggagaggagcgtcaacagcagcaccatggtagctgtgagtatactacataatttatagagtttttttcagtctcagttaacttaaatttaatttatagttggatgaaatatgagccaaggaaaccttaggtttaatgcatatttctaactccactcatagcagactttcaaatatttgacttaaaaatgttagattctgattagtctcctaattattatgtttatagttagcttttcattttaatgggcttcgtttttaaaatttggcttaagaattagttttatgaaatgaacaaaagagccaaagattatggatggaatatttagctacatgactagtaaacattgtagacttctgttctttgttaaatccaaatgtattgaattgatgttttgatcccatgattgctttttaaatgagaatttaaatgtggcagaaacttttaagagaatgtgtgcctctttttgctattttttaatgttgagataagactgcctccaaagtaaaattaaccaatgagactctgcttattcaaatagtcttaactacggacagcatttctcacccatggcaacagaagaaccttgaaggctatgtgggatttgccaatctcccaaat

SEQ ID NO: 18746 - DNA, 760 bp, Homo sapiens
  ENST00000635047
agtgcgagatccgctgctgctgaggagaggagcgtcaacagcagcaccatggtgtttcaatggatttgcctctcctgtttggactgaatatgtcattacaattcttggaattctttgtttactgttcctctgtggatttcttctgttggaatctggaacactggaatgatggaaatgtgttctttacaaagtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacag

SEQ ID NO: 18747 - DNA, 733 bp, Homo sapiens
  ENST00000475109
agtgcgagatccgctgctgctgaggagaggagcgtcaacagcagcaccatggcaacagaagaaccttgaaggctatgtgggatttgccaatctcccaaatcaagtatacagaaaatcggtgaagagaggttttgaattcacgcttatggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggggccaaaaccctgtgaccagggttcaagggcaggagtcaaagccttagccactccaatgcttcttgaagtcctgttctacctaacttttgctggcctaatacatcttcagagtgtttctgataaacttaaaccattggatattgagtttatgaagcgtttgcatgaaaaagtgaatatcatcccacttattgccaaagcagacacactcacaccagaggaatgccaacagtttaaaaaacag

SEQ ID NO: 18748 - DNA, 1464 bp, Homo sapiens
  ENST00000635175
agtgcgagatccgctgctgctgaggagaggagcgtcaacagcagcaccatggttcctctgtggatttcttctgttggaatctggaacactggaatgatggaaatgtgttctttacaaagtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccag

SEQ ID NO: 18749 - DNA, 6952 bp, Homo sapiens
  ENST00000425198
caacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgaggtaatcagtctaatatcccatctcttagcagacattgtgttcctttttaagtagtatcttcagtaaaatttatagataatataacctttttatacatattttttcaaaattaataccctagtgtaacaaaacggataaatttctagaagcaagcaccgtgtttataataaaataatacatacttcaatatgcaagtgcttggacgtagtatattaggtaggacagtgtaatagaatacttataatgaattattagttataatgaacaagtttgagttgtgaaaaataaaattacaaaccattccatacaggtggcataagaacactaaagatgagagtttgggggtggatttatgcacacaaactgtgttaggataataataattgaccatatttatttgtgtatgagtgaaaaagagggaaataacctttattgaactaaagacatgcctggataaattccacacaattaaagaagagaaaattagggaatgtgatatttttgttaacaggttaggccttctttatttataatgtagtgtcaaggtagttcctggtgttacaacattgggcagggtaatgacaaaacatcccagaagacatacctactatcttgaaacccttctagatgttgagttatacatttagtttctattaatcaaaaagaccttggagacatttccttcaataggtggcaagaaagaaaagttggagaaaaagataaactgaacattaaaaatccatagagcagttagtttgatagatgtctgagaatagtagaaaaaaaactatgggtaatcccaaaataacagtggtttcagtatgaagttttcttcacataaatttgttataattaaaaattataaaatagcctgggcatggtggctcatgcctgtaacgccagcactttgggaggctgaggcacacagatcacttgagttcagaagttcgagactagcctggccaacatggtgaaacctcatctctattaaaaatacaaaaattagctggatgtggtggtgagtgcctgtaatcccagctacttgggaggctgaggctggagaatcgcttgaacctgggaggcggaggttgcactgaactgagatcacgtcactgcactcccgcctgggcgacagatcaagactttgcctcaaaaaacaaacagacaaacaaaaagccctataaaataataaattattttaaaatatgtgagatgaggtccaggtgtggtggctcacatctgtaatcccagcagtttgggaggccaaagaagaaggattgcttgagtccaggagtttgagaccagcctgggcaacatggcaagacccaatccctataaaaaatttttaaaaatagttgggcatgatggcctgcacctatggtcccaactactcaggaggctgagacaggaagattacttgagcctgggagatagaggctgtagtgagccatgattgtgccactgcatcccagcctgggtgacagagctagaccttgtctcaaaattatatacatatatatatatggatgacagtaatataaaatagttttaaaacaatctttaatgataaaatttagtaagatccctgttttatgtggcttcactaatatttgtatctaagtgtatgaagaagagattcagatctctcgttatattcttacagttgatctcattgcttttgtaattaccgcataaaatatggaaaccttttttgactaaaggcataacaaaagtatgctaatccattgagtaaatagaatgcacggaatgagaaagtattaaataatttcgaggaaatgtttttattccacatcatttctcttacattattgggcttttcttgtaatttcttattaaaatctttcactgttgttatatttgttgtgagtttaatttagcaggggtatggaataattcctcctggtttcagacgctgagcactacaggattagcatccctggcactgccactaaatgctaatagcagtgccctcctatcatagggcaaaccaaaatgtgcatacacacacacccctaatcaaaagtcactgtcttagctattgctgttgtattataaatgaataattaaagttcttaacatgacattttggagattaatttatcagcatgttgtaaatatatgcattgagtctctacctcttcagtaattcacatataatctggaaaatctatatccaaaagggggaaaaaaacaggaataatcaagagtctactacattatctccacacttagattccattgagaatctaaaagtagtttaacttatatttgaggcagatgtattttaggacatgttgctaaaagtaaatattacgaacaagtaattgtgaacctgtagccaaggaaccctttgggaattttaatgattactgtgaatggtgaagacagttttgaagaactattctttgaaggatggaatgttaacatttcaaggacctgtgaagagctctgggccaaggttcccaccagatactctaagccattagagaattaggcatgctcattctagattctttgtcttttatgaaaccacatctagagtgtatttaccaacatccctgtgataatgagtttgcaaatcatcatgtatatgatacatgatatatattgtgtaaatatacgtgtgaatacataaataggtaaagaaacccttttagccttgtttaatacagtctctccttaaatccattatgctggaaatacttgtttggggcacagctagcagcacagtacatcagccacagcaccaagcaactttcatttattgtgttgtctagtgcacaccacagccctacaaggtagatattattgcccatctctcctttatagataagaaggataaattaacttagtatgccagcatttgaacccagttaatttttaagttaagctagataggtccacagtcctgtttttcacaatttcagaatggaaaaaactctgaaaactgcaaaacctaacatgaactaagttttaatcctacatattgtgaatatttatatattttactgaaacaaataaaaagtaatgtgtttgattatacttgttgccccagatagcccaggaggtattttataaatatagtgtatactcctttctaagcggtgttgtcgttttaataactgaaaaatgttgaacttcaaaaggcatctgaccccatgggtttcttaagagtgagattgtgacctgtacctttatctacatgcagttaacacaaaagataattacttatatgtaacaagttaaagaatgatgaacactgtaagcctactacctggcttaaaaaaatagaatgttatcaactcatttgaagatgctgtgtgcctgtcccctattgtatccctctctctcattcccagaggtaactactattccgaattgtgtatatgtgactcttttcatttaaaaaaaataactagagacattttcttatgttcctactttctgacatttcttagtaacttgtttgctgtcatcaggaagatatcacctcagatttgattcatgtttgcttaagtgtgtcttaggtgattttgttttgtaggaattgcatgaaataattgaaataggaataaatctgaagtcacttcgggcttgcaaaaaaaaattgtatgcaaaattatagtaacatatataatatgtatataatatataatacatataatagttatatattaacattatgttaatgttaactcaccagtgtagtaaaatctgtaacagaacataattcctggataactgaaggttttgaatagtccttgggtatttggcatagaaggatttaatctgatttttaaaatttgttgacttttttttttttcagaaatggattgacttgcacctaaatgaaattacttatctaatgatctcttggacttaaagcactttgtttctgcagttacttcgcatgagtgtttactgcctctcagtcagcattctttacagtattaatacacagagaaggaaggaccagctgcattagaatcactgtaacttgttgaaaatccacatttccagacttaacacccagatattctaattcagtacgtctgagtgaggtccaggattctatatttttaacaaacatcccaggtgatttgcatgaagaccaatgtctgagaaccactgcttacaggaatcagagtactttgctggcatctttgagctcttagggtcctaaactacctgctttcttttcacttgtcttagctttctaaacttggaattaggaggcttattcaagtcctggttcttccactttctggctagcaatcttgggcaagtcacttaaattctgcaactgtttcctcatctgtacaatgagaacagtgatgtgttcactgcccagcctccaacatatttgtgattaaagaaaaacgagataagatagtaattttccattataaagtactccacactgttaagtttgttgctttttttttttttcctgtttcccaagattattgtcttgggtcactggccttttgggtggcaggtcctaaaggaggaggagtccttgaccagagtacttccaggtagtactctgaatttacaacagggctattcaaatagtgctcatactccttatcattagggtgtctggatgaaacatacctctgcttctgatttcttaaatagttttgttttatatattgtgctatgatttagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 18750 - DNA, 582 bp, Homo sapiens
  ENST00000634700
tactgattagacccaggaggtctcaggagtccagagttgcttggagcttggctcagaattccaagggggcccataactccatgaggcccagagttcctggcttgggaacactgggaggcctgggatactgtggcttagactcaagcagaaaggtgaacacagatctttattagcagataccaaatttgacatttaaaggagatttctgagcagctgcagacctcgccaagaccatgcagattccactgactattcccatgccagtgctccagctgctcaggcttgaagctacttcttagaaccactgtatagaacatgctacctgatgaagaataaatcaacaccttgcttcccgtcttctatccattagatatccaggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagta

SEQ ID NO: 18751 - DNA, 581 bp, Homo sapiens
  ENST00000635420
agaattccaagggggcccataactccatgaggcccagagttcctggcttgggaacactgggaggcctgggatactgtggcttagactcaagcagaaagctacttcttagaaccactgtatagaacatgctacctgatgaagaataaatcaacaccttgcttcccgtcttctatccattagatatccaggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtga

SEQ ID NO: 18752 - DNA, 740 bp, Homo sapiens
  ENST00000634591
gcccagagttcctggcttgggaacactgggaggcctgggatactgtggcttagactcaagcagaaaggtgaacacagatctttattagcagataccaaatttgacatttaaaggagatttctgagcagctgcagacctcgccaagaccatgcagattccactgactattcccatgccagtgctccagctgctcaggcttgaaggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaac

SEQ ID NO: 18753 - DNA, 686 bp, Homo sapiens
  ENST00000473201
gtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatgggtcagtaccttgatacttctgattccttttttgttgttgttgcttactgttacctttatgtgcatactttagtaatctttaagtttgtgaagtacacacaactatagccattatgaagtactaaatttcatgtagaaatgtcttagttgaaaagccattttaagtcctatataagctaacagtgattttactccttagttcttcattcataaggattttccctgcttcatgaaataaacagtgttgccaccatggtttgaggtctcaatgtggcaaatttagctttcatgttgaccactctgctactaatagaaataccaaataaagagaagcagccatacca

SEQ ID NO: 18754 - DNA, 556 bp, Homo sapiens
  ENST00000492940
tgaatgccaccttccttaacaatagtcttttgttcattttaaatctgaaatttttgttttggtaaaattttgaattcatattaaaactttttaagcttttttccccctagctattaatagaagcaaactcttgctgtttgtttatgacagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgaggtaatcagtctaatatcccatctcttagcagacattgtgttcctttttaagtagtatcttcagtaaaatttatagataatataacctttttatacatattttttcaaaattaataccctagtgtaacaaaacggataaatttct

SEQ ID NO: 18755 - DNA, 333 bp, Homo sapiens
  ENST00000485569
gtgacttataatggagttgataacaacaagaataaagggcagctgactaaacatttaatgattacccttaatattcgtgacaggagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgt

SEQ ID NO: 18756 - DNA, 4350 bp, Homo sapiens
  ENST00000350320
gagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatgggtcagcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttc

SEQ ID NO: 18757 - DNA, 1362 bp, Homo sapiens
  ENST00000432293
ggaatgccaacagtttaaaaaacagataatgaaagaaatccaagaacataaaattaaaatatacgaatttccagaaacagatgatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 18758 - DNA, 4066 bp, Homo sapiens
  ENST00000399035
atgaaacaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttc

SEQ ID NO: 18759 - DNA, 2146 bp, Homo sapiens
  ENST00000373710
tactttagcctttgctctgaaatcccatgcacgctttgtgaggaaggacagccttggttggggggtgtttatggggagagcagagtggatggtgcgtatgtgaatacctctccccagatgctcccccaatcccaagctctcattatcttatatgcatattcataagggatggccctgctctgtaaatgggtcagaagcaggaaatagaggccagtacagacagcgaagcccaagggataggagggctcaaagccggcacacatctgagtcctcatggacgggaggatgatgagaagcatgaggctgagagaggaggagtcacccggacccagccacacagcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtacc

SEQ ID NO: 18760 - DNA, 735 bp, Homo sapiens
  ENST00000487207
aagagacagagctactctggccccatgcaggaggttcaaatctgggagtaaaggctgatgggctggccaggacaccaagaaatgaagctctttatccatgtcctcacttcatctcctcagtagtcccctcagatagctggggtaaaaaaacttatctttattttacagatgagaagcatgaggctgagagaggaggagtcacccggacccagccacacagcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctgg

SEQ ID NO: 18761 - DNA, 1997 bp, Homo sapiens
  ENST00000373709
cgagcgccgccggaaagcgtcgagcggcttcggtaggtggggcggggccggggcggggccggggccggggaggggccaggcccggcacccggatcccgaggtccgcgccccgcgcccggcgccgggcgcccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtacca

SEQ ID NO: 18762 - DNA, 2807 bp, Homo sapiens
  ENST00000491976
gtatttgtctggttcctgtctgtgtccgtcgttcgtccgactgtctttgtccgtctgctgtcttctgtccgtctgcccgtccgcccgtccgtccctcagtctctctgcggtccctttaccgtcctcagtctggctcgcgctgcctctcaggcacttccccagctcgccccggatcatctgggccccagcgcggagactgggatgggagcggagggagccccggactttcttagctgccctcgagtgaggcgggtgcgggtcgtcacggaccaccgggcggaactctgggttgggagagcaggaatcgagggaggttcgggtgtgcgcggggagtgcccggtcgcgggttcgggacctgtggggaggccaacctctgttctgtagctgcagccgcagaggggaggggctccagcaagaccccggctgggaggcccgttctcccttccctttccccagcccccctctcctttcctcttcccctcattaaatctgaggttcattcaggcagccccctccccctctggccccacacaaagaggccctgagagggagaaggggctgcagcggctgctgaatctcgggactcgctttcctttgtccctgacgggttgtgtgtgtgtgtgtgtgtgtgtgtgtgtgtgtgagagagagagagagagagaggagggggtgtaggggagagctgagggtctagagatttactttacagcctttttctgagaatgagatcagcatagacagcacagagaggcaagagagcctctcgcctcattaggcctccatttttcgtgtgtgtgtgtgcgtgtgcatgtgcgtgtgcaggaggaggaatcaagctggtgcctgaaatccctcccagcccaaagaattcaaggtttgggccaggtctctgccaacaagggtttgcttcctggtgagggaggcagagcttccacagtggacctgatttccatcggttgcacctgcattggaactgggctgaaggtgaactgggctgaaggcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtacc

SEQ ID NO: 18763 - DNA, 2062 bp, Homo sapiens
  ENST00000536384
gtatttgtctggttcctgtctgtgtccgtcgttcgtccgactgtctttgtccgtctgctgtcttctgtccgtctgcccgtccgcccgtccgtccctcagtctctctgcggtccctttaccgtcctcagtctggctcgcgctgcctctcaggcacttccccagctcgccccggatcatctgggccccagcgcggagactgggatgggagcggagggagccccggactttcttagctgccctcgagtgaggcgggcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtaccatg

SEQ ID NO: 18764 - DNA, 2072 bp, Homo sapiens
  ENST00000536859
agtatcacatagctgctgactgtgactgtgcttttgggggtgcaagagacagagctactctggccccatgcaggaggttcaaatctgggagtaaaggctgatgggctggccaggacaccaagaaatgaagctctttatccatgtcctcacttcatctcctcagtagtcccctcagatagctggggtaaaaaaacttatctttattttacagatgagaagcatgaggctgagagaggaggagtcacccggacccagccacacagcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtaccatg

SEQ ID NO: 18765 - DNA, 3934 bp, Homo sapiens
  ENST00000479209
actcaccaccatcttggtagtgtgcaagactctgggacggcatgagaaaggcagaaagggagcaaaggagctggtggggtgtcacagggcctatgtatgaggcagatgtgagttctgcatccagttttgcaatttatccatttacctgcctgagacttggaaacacctactttatagtcctgattcaagtgttggcggatggaagggaggagactcctgaccctcagaatgacctaaatgacttcacaagggcccgtgtaacaccagtattgcagacccatgtgtcacaaattcaactagcacattgtttttctcccccttcttctatttctgtagaagatgaatccgcaggcaagaatgatggatgggtgaaagggagggggaatacgaaagcccagaggcggagacttcacttccgattgccacgctatatcaagaaagccaacagtctggcctttccgcaagccacaagaaaaggcagatcagactccccggctcctcgggtagttctcaaaggcaaagacaaaaataagaaactagtctgaagaaagagagtccctcgcttcttcagaactcacctgtcaagagcggcgtggacggcgccatgttgtcccggaaagagaaaccgctcgggtgagagttcaccagggccgaacccggcccctacacgtctcctcatgcgtggagacagcgaattggtgtttccggagccatcagcctcggggccaattcacttccggttacggagtgacgcggaaaaggcgcccaaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttaactctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaa

SEQ ID NO: 18766 - DNA, 657 bp, Homo sapiens
  ENST00000487153
aaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattcca

SEQ ID NO: 18767 - DNA, 830 bp, Homo sapiens
  ENST00000491660
agtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctggtaagtggcttgggggctcccatcaggtagagtcttgggttgaaaggatttgggatgacgtggtgaccggtcagtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggaggtcaggtcttggtaatgatccagttggaataaatgttaagaccggacaaaacctaacgaaatgagaatttagaa

SEQ ID NO: 18768 - DNA, 716 bp, Homo sapiens
  ENST00000491195
accaccatcttggtagtgtgcaagactctgggacggcatgagaaaggcagaaagggagcaaaggagctggtggggtgtcacagggcctatgtatgaggcagatgtgagttctgcatccagttttgcaatttatccatttacctgcctgagacttggaaacacctactttatagtcctgattcaagtgttggcggatggaagggaggagactcctgaccctcagaatgagatcaatggcttttcaaaagcagcacaccaaactgtcaaagtggtgatccctcttcatttgacatgctcacaaagaggagaataagacaagaaagcaagctaacccagaaacagtgaggtgacagtgcgcctcaaacacaggaaaataaaatgcataactatactgattggatgctgctcaaaatcagcctacatgccatctttgaagatgaatccgcaggcaagaatgatggatgggtgaaagggagggggaatacgaaagcccagaggcggagacttcacttccgattgccacgctatatcaagaaagccaacagtctggcctttccgcaagccacaagaaaaggcagatcagactccccggctcctcgggtagttctcaaaggcaaagacaaaaataagaaactagtctgaagaaagagagtccctcgcttcttcagaactcacctgtcaagagcggcgtggacggcgccatgttgtcccggaaa

SEQ ID NO: 18769 - DNA, 1596 bp, Homo sapiens
  ENST00000490945
cccggcgcccgcgcacactcctggagtgaagagccgacctgtttcactgtcctgactcaccaccatcttggtagtgtgcaagactctgggacggcatgagaaaggcagaaagggagcaaaggagctggtggggtgtcacagggcctatgtatgaggcagatgtgagttctgcatccagttttgcaatttatccatttacctgcctgagacttggaaacacctactttatagtcctgattcaagtgttggcggatggaagggaggagactcctgaccctcagaatgagatcaatggcttttcaaaagcagcacaccaaactgtcaaagtggtgatccctcttcatttgacatgctcacaaagaggagaataagacaagaaagcaagctaacccagaaacagtgaggtgacagtgcgcctcaaacacaggaaaataaaatgcataactatactgattggatgctgctcaaaatcagcctacatgccatctttggtacgtgtgaacaaagttaccaattcctattctaactatgatatactcaaaactgtacaatcagtaatgggatgctctaaagacaaaagaactgcaaaccctttttaaaaaattattttcagtaacagtgttactttttggtattaagattgtaagaataccttgtggataatgtggaacaaaccaaatgaatacttatgtgaatgtgatattctcaaattatcatccctggtattccagagtaacaagattcttggtggtgacagaaggcaatacaaataagatagaagttaaataaaaaccttgtagtcttcaatttaaataaaactatacgtataaaactttaatttaaataaaattatgattgttacatcttttaaatagaaaaaaaaggcctagaaacaatgatcaatgcaacagcaaataagaatctctagaacctaaatacctttttttttgctagactcagccaatttttcaagaaaccctattaccttttaatgtttccttcaatgagatcaagagctaatactttttctttgttcaatttcagagatcaatagctattcaaaagtagcacaccaaaaaggcgacagggtttcctgaaaaattagccagttctaggtgtaatggttagaaatgtacaaattaatcctagaatgacttgtcttaccatatagcaaagaagtcactaaggattaattgatcaaagatgagacaatttgagcatcaataagaaaaataactacaatggactgaaacacataccttttaaatccacagctcattaagaatgggactaaaaaggccaggcgtggtggctcacgcctgtaatgccagcactttgggagggtgaggcaggtggatcacctgaggtcgggagctcgagaccagcctgaccaacatggcgaaaccccatctctactaaaaatacaaaattggccgggcatgttggcacatgcctgtaatctcagctactcaggaggctgaggcaggagaatcgcttgaacctgggaggcagaggttgcggtaagccgagatcgcaccattgcactccagcccgggcaacaacagcgaaactccatctcaaaaaaaaaaaaaaaaa

SEQ ID NO: 18770 - DNA, 761 bp, Homo sapiens
  ENST00000463647
ttcaaatgcaaatttccttattaagaatgtgaaactcaaagatcaatggcttttcaaaagcagcacaccaaactgtcaaagtggtgatccctcttcatttgacatgctcacaaagaggagaataagacaagaaagcaagctaacccagaaacagtgaggtgacagtgcgcctcaaacacaggaaaataaaatgcataactatactgattggatgctgctcaaaatcagcctacatgccatctttggtacgtgtgaacaaagttaccaattcctattctaactatgatatactcaaaactgtacaatcagtaatgggatgctctaaagacaaaagaactgcaaaccctttttaaaaaattattttcagtaacagtgttactttttggtattaagattgtaagaataccttgtggataatgtggaacaaaccaaatgaatacttatgtgaatgtgatattctcaaattatcatccctggtattccagagtaacaagattcttggtggtgacagaaggcaatacaaataagatagaagttaaataaaaaccttgtagtcttcaatttaaataaaactatacgtataaaactttaatttaaataaaattatgattgttacatcttttaaatagaaaaaaaaggcctagaaacaatgatcaatgcaacagcaaataagaatctctagaacctaaatacctttttttttgctagactcagccaatttttcaagaaaccctattaccttttaatgtttccttcaatga

SEQ ID NO: 18771 - DNA, 632 bp, Homo sapiens
  ENST00000484608
caccatcttggtagtgtgcaagactctgggacggcatgagaaaggcagaaagggagcaaaggagctggtggggtgtcacagggcctatgtatgaggcagatgtgagttctgcatccagttttgcaatttatccatttacctgcctgagacttggaaacacctactttatagtcctgattcaagtgttggcggatggaagggaggagactcctgaccctcagaatggcttggagtgcaatggcacgatgtcggctcactgcaacctctgtctgccgggttcaaacaattttcctacctcagcctcccaagtagctgggattacagagatcaatggcttttcaaaagcagcacaccaaactgtcaaagtggtgatccctcttcatttgacatgctcacaaagaggagaataagacaagaaagcaagctaacccagaaacagtgaggtgacagtgcgcctcaaacacaggaaaataaaatgcataactatactgattggatgctgctcaaaatcagcctacatgccatctttggtacgtgtgaacaaagttaccaattcctattctaactatgatatactcaaaactgtacaatcagtaatgggatgctctaaagacaaaagaactgcaaaccct

SEQ ID NO: 18772 - DNA, 3171 bp, Homo sapiens
  ENST00000239944
aaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttaactctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgc

SEQ ID NO: 18773 - DNA, 2619 bp, Homo sapiens
  ENST00000380739
cgctcacttctgcttgcacttaggcgacctcgggagctcggactcctacgcagtcaccgggaagggccgccgccccgcccgcggctgctggcccgggtgacgcttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgttcagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctgcattcccttttttgttcttctttatgtataatatatagttcatgtggcgctgcatgaaatcaagaagtgggtgtcttaggataaaagataccaagagtctacaaaaataaccatgtagtaagataaactgctgaacaaaggttttactgttagccaccttctcatgtgttttcttttctctttttctttttctttctttctttcttttttttttttttgagacagagtcttgctctgttacccaggctggagtgcagtggcacgatctcagctcaccgcaacctctgcctcctgggttcaagtgattctcttgcttcagcctcctgagtagctgggattataggcatgcaccactaggcctggctaatttttgtatttttagtagagatggggtttttccatgttggccaggctggtcccgaactcctgacctcaggtgatccgcgcacctcagcctcccaaagtgctgggattacaggcatgagctaccatgcctggccttctcatgtgttttctgattaaggctcttgacttccaaggctgtgtggggagatggggtgggggctcttggactgatataaaactttgtcaaatgtagttctttgaatggagcttgaaacgccgcatattcttgctcccacaaggatagtgggcatcatgaattaataaaacgtcctaggattctgcaagcta

SEQ ID NO: 18774 - DNA, 449 bp, Homo sapiens
  ENST00000468511
gagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaac

SEQ ID NO: 18775 - DNA, 782 bp, Homo sapiens
  ENST00000490094
acgcagtcaccgggaagggccgccgccccgcccgcggctgctggcccgggtgacgcttccgcctgctataagagcagcggccctcggtgcctccttcctgacctcgcacccagctcggagcccggagcgtgcctcggcggcctgtcggcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaag

SEQ ID NO: 18776 - DNA, 872 bp, Homo sapiens
  ENST00000476896
agctcggagcccggagcgtgcctcggcggcctgtcggagctgtttgtgacggtttccaggcagcccagggccaggccgcggctcctatctgcagctgcagggagagagaggaggaaccccgtgcgattctagagacgatttcacaacaaggagaaatcagctttgtgcttacatgccgagcagccagcacggttcttctttgcctgtcctcgggggaaatcagggctctgagagtggagatcgagatgggctagtgggtggcggatgggacgctgcacggccagaccctggactgtgttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataag

SEQ ID NO: 18777 - DNA, 580 bp, Homo sapiens
  ENST00000460260
ctgacctcgcacccagctcggagcccggagcgtgcctcggcggcctgtcgggtaaggccgggcctcggagcggtggcgcgggggcgggcgcggggagaggccaggctccctcgctcagcttccagcccggcaccccccaccccccaggctcaggcccctcagacccgcagctccctgcgctcgccctccccgccagcttcgcgcccccatcccttccgggcgccccgacggagacagacgacctctgatcccccgcccccgcctggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcct

SEQ ID NO: 18778 - DNA, 2161 bp, Homo sapiens
  ENST00000409304
ttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaatacaatagaagaaactga

SEQ ID NO: 18779 - DNA, 2195 bp, Homo sapiens
  ENST00000258405
cgataaagcccccgccgccgcggcagccagcttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaacagggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaatacaatagaagaaactga

SEQ ID NO: 18780 - DNA, 5989 bp, Homo sapiens
  ENST00000473202
ttcacagctgtagcacaaacagatttgaaggagccgctgaaagttcttggcattactgacatgtttgattcatcaaaggcaaattttgcaaaaataacaagtatgttcaatttaaaatgtatttgtatacttgaagaaagtgttacaaactgagactgatttgtgcagagaaaaaggatcagaattaggaatgtgttgccctgaaactgtacaaggtttcatttgatacattgccaaattatgctattggccttcgtttatttattgaccttcatttatttattttttccttttatctttttatttcaatagtttttgggatacaagtggtttttggttacatggatcagtttatatagcgatgaagtctgagattttagtacacccctcccccgagtagtatacgttgtactcaatatgtattaatagatttttagctcctcaccaacccaccctcctccttctgagtctccataatccattataccactccgtatgcctttgcatacccgtagcttatctcccacttacaagcgagaacatacagtatttggttttccattcttgagttacttcatttagaataatggcctccagctccattcaagttgctgcaaaagatattatttcattctttttatgactgagtagtattccatgatgtgtacatacctcattttctttatctagtcattgctcttgaccttcatttaaatcagcgtccccacattttgcacgtacatttcatgggaagccccagtgactacctaaaggagtatttcatgtattgcttttatgaatattggctctgacttaggtgttgtcgctctgttttcaaatgccaactttttccttttgcttgaaaaaaagtcaagactgcagtcattcactgtacccagatatgtattttggcatttcatgctcattaatatgaaacgatataaattcaaatgaatctgattaaaactttcctttgccaaagcaattaaggcatgcttttcatttgccagcagtatatgtacctttttctagagttatgtttgaatggtcagtcctttgttctttaaatttagaacatagcaatctttccaaggaaaagccatggcttgaacattatttgcactccagtttgcaaataactttgagtggtaagaaattagctcattaccagcttcagttgcatgctagtaaacacctagtacctgttctggggacaaacatgactcccctggtgaacctgcagctccatggatattctgatagccgttcatccctcatgactcaaactcaggcctccagcccagcagcattagcatcacccaggagcttgtttgaaatgcacaatcttgggtgtaacccagacccactgaaccagaatccattttaacacagtccctcagcccagcaaagactgagaagcaccattttcatctgcacttttcccttcaaggttgttcatggtagctgaaatactaaatggggggtgttcacaggaagaaccaggtgccccagattctcctggaaagtcctctttaacactgcatgtgacttgggccctataaatgtgcatctcagtcacaatttggtcatattagagctgggcattggtgcagatagttcacaagcagatgacacaaaaagcacattttccctttgcatccagacctatgtcccatccagactaatatcaacttaagtttttcattctctgtgaaagctacacccagtgggtgttgctggaatggtcagaatttgctgagaagtaaagtgagttcaccagaatgtccctgaggcacaactgcatttacacatcggcccttccaggaaaatctaaactcttctcttgttcgacactcttctcttactagcatgcccatgagatgagtggctgttgtgaagagccaggacttactctgccactaactagccgtatgattgcagggaacattacttaacgttctaggcctcagtttccccatctgtaaatgctgtctgaaatcccttctgcatctgcattctgtaactgaaaaataatcttgttgccttgctgcttccagaaaaccgggcttcctttttaaagctctgctcttttcatttttaaaaaacaattctagtgatcagaattgaattgatagaggcactaaatcatttgagggcctgggcccttctccagaagtgagtatcacagttcacttagcagggactgaaattcacaagtaacagctgtctgcagccttcaacaccaggactgtcagaggtcatgtcttctgacactttaaaaattggaatttgccatggctttgagctttgaggttacttccccaaccaaccaatggcctgcctatcaaacaaatgctgatactgttttattttctggaagcagggtcagaaaacctccatgtttctcatatcttgcaaaaagcaaaaattgaagtcagtgaagatggaaccaaagcttcagcagcaacaagtaagcactgggtcacgtggcagggcttcctctagcaggggagcaaacacattcctgtatactcattggttgagcaaatatgtaatgcaccctctttccagccaggcagtgtgtgtgggttaaccctcaggagacagcagtgagtacagacagactgaagacctgtaaccacaaagctcagaatctgtttcattaaagaaaagcatttcagtgagagaaattcctctaggacaggagtcagcaaacttctataaagagccaggtagtatgtatttcagatttgtgtgtcataccatctccattacagcttcttagctctttcactgtagcatgaaaacagcaatcaacaatacaagtaaacagatgtggctgtgttccaataaaactttatttataaaaacaggatttgtcctggtagacttgccttgaggaaaatagtttgctgacccctgctctcaggaggataaaacatgttctggcttcttactggcaaaaaagaccaatcttcagatttgaacataaaataaacaacaagtacttaaaggaaaataggcaatcaggtctatccaggataaaccgaagaattcgccagcatctgttgaattgcggcaggattgctgtacagccttccttgataattagaacatccacatctgcttcctcctcagtggtttacataatgaaggagaaaacagaacaatcgtaagtcagttttttcacccctcattatccgtaggaaaatagatgaatagatttggccaactctgtgagcccataaagtgaaaatcttagctacacttgcagctgggtcaaatatctctggtcattgaaacataccagttatactcacaatagatgtgttattgcctttctcgaataaacgttttaaaaattcctttaaagaagcatttaaaacaaagaccctgaaataagagggttggaaattttaagatgctttttgtcttttctaggtaattttaagtaacatctaaaagttattgaccagttttgctgagtgtaactatcaggaccagctacatagtttgtggggtcctgtgccaaatgaaaatatggagccccttgttcaaaatgtataagaatttcaagatagcaacagcagagtattaaacccagtgcagggccccatgtaaccgcccaggtcctcctgtcttagtccgcctgggctgccatgacaaaataccgttgactgagtggtttaaacaacagaactcacacttctggaggctgcgagttcaagatcaaggtgttggtgttggcaggtttgtttctcctgagatctctggatctccggaggtcgccccctccctgtgtcctcacatggtcttttctccatgtgacacatccctggtgtctctcccacttcaaataagggcaacggtcctattagaatagaaccctacttaaccttcattacctcctcaaaggcattatctccaaatacagttacgttaggggtttggggcttcagcatatgaatttggggggagacacatttcagtccataacacctgctatttaatatttgtttttaataaccctgggtaaaagggcttgccccagcataactgcagctgtttcctttataacatcaagcccaagtgttcaatacttcatggggtttgagcaagaggactgagctattgcaacaggcatgtggtagtaatgccacacacctaccctcccgtgaggccctggttcaggcttattaaatggaaacaagcctggcagacgaggaatggccaagacccatgaggctaaagaagtttgctttccaagtcagatgcctacacctggtgagtggaacagcagtataaggtagtaggtcccggatgagtggtctacattccagtgcagaggaaacctaaataatgtgccaaaggagaaggcacagacacaaaagctaagaattggactgggcctttatatacagaaaagatttagagaagctaaacaggaccaggggtcgggcgcggtggctcatgcctgtaatgcccgcactttgggaggctgaggcaggtggatcacttgaggtcaggagttcaaaaccagcgtgaccaacatagtgaaaccctgtctctaaaaatacaaaaattagccaggcgtggtggtgcatgcctgtaatcccagctactcaggaggctgaggcaggagaatcgcttgaacccgggaggcaaaggttgcagtgagccaagatcgcgccactgcactccagcctgggtgacagagtgagactccatccccaaaaaaaaggactgggggctttatcagcaaagcagatggtgtgaataaaaaatagctaataacaataaatatgcattagatgtgtttagtggcaaacactgttctaagagctataatatatcttatgtcatttaattatgtcatttaattctcatcaaaactctatgaggagtaagtatgtttatcagagatggtgcttgtgtagaagacatgagagagtaatgtaaagggcctggcccaaggtaggcttagtaaatggtgaccattgagcctgttgtaacatggccagcctatggaacaagcatgaagtgtgtcttcagacaccagcctctgagggtccatgaagctagctaacttgctggccttatgcttacatggtctcatgtaatgtgcacaacacattttccttttcttcccgtagctgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaa

SEQ ID NO: 18781 - DNA, 2569 bp, Homo sapiens
  ENST00000409840
aatccttggttaggaggaaagggagtggagaggaccgtgctgcctggcgttccccagctgcctttctttctgttttccccccaacggaatctctatgtggtctcctagagcctcgtgcctgcctctcagctagatgctgatatcattcccactcatgtagttgggaaggaagggtgtggcagagataaagggtccacggtcacgcagtatgtggggggtcacacagcctgtatgccaaagtggcacaccctgtgaatatgtagggtcgcacagcctttatgtgtcagtgccagagcctggacccgggtctgtagatgtgtgaaccgtgagctgataccatggatattcaaagatttacatcccatcaatgtttataccttcttgagaagaaatttgtgtcaaagcacactcctcctttcaagactacctcctcgccgtgctgcgtgatagccctagtatcacaaccaaaacacatgatacagaaagaggccagtatctgtgtggcttcaggctcttgtgcgttggccatgaagcaaaggaaggctgttgcatgaaataacctccttctgactccacccttgcatttgtgagatgtaaacagcagtgttaccaagaggtcttccagggaacacgttgcaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaa

SEQ ID NO: 18782 - DNA, 1716 bp, Homo sapiens
  ENST00000447280
agtgatacccgcagctgggagcaccggggccggcgtggctcctgcccggccatccgagccggccctgaccctgaacctgaggtttccagctgctcgccggcaacccctaccccggacttaggctgcgcgccgccggatggggagagactggcgcactcttacttgttacctctgcctgggcagagggaggtgacgcgcggtgtggggaaagcctttaacttggcctctggcagccgatttaacccgagcgagcaggtctttgctattttcatcatctgtagaaacgggagttgcgaggcggatgagtgactgcaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagca

SEQ ID NO: 18783 - DNA, 680 bp, Homo sapiens
  ENST00000478966
ggaaaagggaagttctccaactgagttgctctctgaagctatcccggtgaccagcaagcactcatcctgcttctagaagtcaacaaggatacactgaacctgcttctgatttctttagggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaag

SEQ ID NO: 18784 - DNA, 988 bp, Homo sapiens
  ENST00000432738
agcccaggttcatctacatcctgttgagaagtttggcagctggaggtggacatgcacacactacactgaacctcctgcaacaagcactgcggaagggaccatttggatgttgctgccatacttttcagcggctgaaaaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagac

SEQ ID NO: 18785 - DNA, 563 bp, Homo sapiens
  ENST00000489065
gcttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggtgcgtgtgcacaattgctcactggcggagcctttgcctgagagtcttgtgacaggagggtttatggcttggtttttgctgacaacccca

SEQ ID NO: 18786 - DNA, 546 bp, Homo sapiens
  ENST00000454956
gataaagcccccgccgccgcggcagccagcttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcgggaccatttggatgttgctgccatacttttcagcggctgaaaaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatgg

SEQ ID NO: 18787 - DNA, 581 bp, Homo sapiens
  ENST00000423446
atcacagaacaagtgtgccatgacttttcaaacatgcctaattgaactctgtttgcgatttaacttctttttcaaaggtttatagttacctttatttcaaaatttgtcattttaaaatatgtgtttcctccttttcctccactgtatagtaattaagagtgtggaggatttggaggccagcgggctttggtttgaatctagaggctacatattggagggtatgagccaaagccaaatttctaaacatctccaagcccatccgtgagttgggcctaaaggtgtttaggcttaagggccacccctgaagtgttgtgaggatgaagcgaagagtatatcttaggcgctaagcacagtggcaggaatggagctgactttcgggacacgaggtggctgtggttgtggcattgggtaatatttgtcacagaagtacaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattg

SEQ ID NO: 18788 - DNA, 2299 bp, Homo sapiens
  ENST00000533603
agtaggacccaggggccgggaggcgccggcagagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 18789 - DNA, 2225 bp, Homo sapiens
  ENST00000358171
agagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 18790 - DNA, 474 bp, Homo sapiens
  ENST00000526242
tttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcct

SEQ ID NO: 18791 - DNA, 882 bp, Homo sapiens
  ENST00000526397
ggagcgggctaagagtagaatcgtgtcgcggctcgagagcgagagtcacgtcccggcgctagcccagcccgacccaggtgaggggcgggagacgcctgcgcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaa

SEQ ID NO: 18792 - DNA, 660 bp, Homo sapiens
  ENST00000529643
aagagtagaatcgtgtcgcggctcgagagcgagagtcacgtcccggcgctagcccagcccgacccaggtgaggggcgggagacgcctgcgtgcgtgcggcccgggggagcgccgagcaatctgggggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcg

SEQ ID NO: 18793 - DNA, 529 bp, Homo sapiens
  ENST00000525492
aagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaa

SEQ ID NO: 18794 - DNA, 1358 bp, Homo sapiens
  ENST00000530284
aagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattatta

SEQ ID NO: 18795 - DNA, 998 bp, Homo sapiens
  ENST00000532356
gtgcggcccgggggagcgccgagcaatctggggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaa

SEQ ID NO: 18796 - DNA, 3391 bp, Homo sapiens
  ENST00000524558
aatctgggggtgcgcgagggagtaagaggggcgaggggaccctgcgaagcgttgggtgccgagccagagcctacaaattggagtcctcggcactttgggggccgctggagggtttggaatcgagagcccagggctagccagtgatggtgccagctgagggctagggcggagatcggagccgggttgggagtccgtgcactcggaggactgggaaaaagtgcagggacccctaaaaggtggtggtggcagatacgagactaggtgctgtgtaaagggggctgggggcagagagcagagcctctgcggaaagaaacagaggaggaaggagatgggtctggtgcctcttcccgcaagggtagggaggataggccggcctcgcagttccaggtcacttccgttctggggttgaggctcaggggcagcggtgattggtggcccagcctcctcacaggcttgctgagggaatttgagcttccggtggtgggaaaggaggtgaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtgggggtcagcagggtctgctctgctctggggattaaggggctgactagaaggatttgagtctttccttctgtccactgccacagggttcttggagtaactgcagggtttaaactgcagggtctaacttccagaggctggggttccctgccccccagcttagagacattcctgaggtggctgaagagcaggaaggagaatgaatgcacttccagactggcccagagtctcagcccctcctcttccttgtttcccgctggtccctctgggctgtacggcccggatggaggcctgaggaaaatgagggggctttggttctccggaattccggccggggccacaccctcctgtcttcagatggttcatgtacccatccccccttcccgtcctctcctttgtctcctctgtcaccgggactcccagcagagattttttttttgtactggctgtgtaacaggacaccgcatgcagccctcaggaggggctctgtgcttctgtgaggaaggacccctgtgctgggaaggcagacccctgtttatcccgagggacctggggtgaccccctgccctggccttgtttctcccattttacagtgaggtggtcgatctccaaggtccctgtagattggggactggttgtgccctctgcgccaggggcctcctcaccatctctcctttgccggctcccgccctcttcactcttctgttttctttcagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgac

SEQ ID NO: 18797 - DNA, 587 bp, Homo sapiens
  ENST00000528990
tgagggaatttgagcttccggtggtgggaaaggaggtgaaatcgtctcgactcctggggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgac

SEQ ID NO: 18798 - DNA, 582 bp, Homo sapiens
  ENST00000533449
aatttgagcttccggtggtgggaaaggaggtgaaatcgtctcgactcctgggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaa

SEQ ID NO: 18799 - DNA, 974 bp, Homo sapiens
  ENST00000525611
gaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtggggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacga

SEQ ID NO: 18800 - DNA, 773 bp, Homo sapiens
  ENST00000528760
cgggactcccagcagagattttttttttgtactggctgtgtaacaggacaccgcatgcagccctcaggaggggctctgtgcttctaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgcca

SEQ ID NO: 18801 - DNA, 2283 bp, Homo sapiens
  ENST00000525876
gagtacctccatagacaacactattctcacagtttgctgtgagaatgaagtaaccctcgttttacaaatgaggccaagctaggagagctgaggtctccccgagtcagtggctgagcttggattggaacacaggtctggctgtgagcaagggcagggttcaggccactctcagacattttttgttgttattttctggtcatggagacagaacttgcagaggaaaacgaagggtgggctgagcacagtagctcatgcctgtaatcctagcactttgggaggccaaggtgggtggatcacatgagcccaggaatttgagaccagcctgggtaagatggcgaaaccccatgtctacaaaaaattagccaggcgtggtggcgcatgctggtagtcccagctactctggaggctgaggtgggaggatcgctggagcctgggaattcaagactgcagtgtgtcatgattgtaccactgcactccagctgtaggatggagtgggacggaccttgtctcaaaaagaaaaagataaaaaaaaaattaagggtggtcatggggcactccctgcccagggcacagctgtcccccaggtaccagggagggtagaaagcccacctcagagcatgtttccaaaatatctgacaagtgctagagccgggggtggccatagaggtggctgacctgagggcggaattaattctctatcatatgggagcagcaggcactgactgtagggaaccgcatcctcagatggcatgtcctggggccaagaccccttcccaaagctgggaacatagactctgtgggctgggtgctctatagctgggccctgaagaatggagcaaagacctgtggcaaggataaatcaaggtctgcagccgggggtggctgtgggctgtgattgtgtttgggggcggccatgtgtctctgaccctgtgttttgccccaactacagcacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgac

SEQ ID NO: 18802 - DNA, 719 bp, Homo sapiens
  ENST00000526638
gcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 18803 - DNA, 582 bp, Homo sapiens
  ENST00000472941
gaggggcctgtggtggggatcctggggctgtcgggctgagtatgccgtgtgggtggagaggaagcctcggggaaatcgcccaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaaca

SEQ ID NO: 18804 - DNA, 1890 bp, Homo sapiens
  ENST00000446050
gaaggataggctgagccggggctcccagcagagacgcctgggtggggcaggaggccgctccaggtgtgagccacagaggaggggagagggacccccacgggagtggaagtggcagagcagctgcagaagtgcagggagcggaaaggtaccagggcagctgctttccgctgcctccggtccgggcagctgcagaaacagcagggggaggagcaacagctgccaaattcgccaactagaggagggagaggcggagcttgggtccctgtagaagccagaggcgcagtctggactgtagtttcccgggagagacgaaagcaggaacgagagcggagcggagcacagtccgccgagcacaagctccagcatcccgtcaggggttgcaggtgtgtgggaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtg

SEQ ID NO: 18805 - DNA, 1907 bp, Homo sapiens
  ENST00000295777
agtttcccgggagagacgaaagcaggaacgagagcggagcggagcacagtccgccgagcacaagctccagcatcccgtcaggggttgcaggtgtgtgggaggtaagcgtgggtccttcttcggggcgtctgcactgccctggagaaaacgtcttccaataggaattacatcaagacacagctaaaagagtccgcgttgggttaggaaaccggtgcaaaacctctcgggtgaaagatttacatttttcgactttaagggcaaaaaagcaaaaggaagcttgactctgggtataaagggcgtggttagtgtttttggtttgagttgcaccagtaaaactgttctgggagatctgaagattgagaaaaatcctgctaattgaggacgaggtggatgttatctggtggatgttataggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatg

SEQ ID NO: 18806 - DNA, 842 bp, Homo sapiens
  ENST00000472747
tttcccgggagagacgaaagcaggaacgagagcggagcggagcacagtccgccgagcacaagctccagcatcccgtcaggggttgcaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccat

SEQ ID NO: 18807 - DNA, 668 bp, Homo sapiens
  ENST00000488374
cagtaagttctacagaaattatatgctgaattgaaattgtatttttatccaaaatataagaatctattcaagaaaaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaa

SEQ ID NO: 18808 - DNA, 595 bp, Homo sapiens
  ENST00000466865
ctccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattg

SEQ ID NO: 18809 - DNA, 541 bp, Homo sapiens
  ENST00000494666
ttttcctatctctgaatgaaaaaaaaaaatttctgattctctttttgcagataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattg

SEQ ID NO: 18810 - DNA, 1837 bp, Homo sapiens
  ENST00000476257
ttttgtagctttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataagaggaattaatcaagcaatggtcaagataaatggagttggccttgatcgctcaggtgtttatgtacaagagttttccagcaagcgtattttagttgtaacattccagtgaataatcagaagtcagtttgggagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccct

SEQ ID NO: 18811 - DNA, 1514 bp, Homo sapiens
  ENST00000461846
aagatccagttcttataggactattcatcaggttgtttagttcagcattactttgtgctttctgataagatatgatccaaaacctgatgagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttag

SEQ ID NO: 18812 - DNA, 1331 bp, Homo sapiens
  ENST00000471111
gagctctctgtggaaaactctattttgaaaatgaatatattttgatttaaacaatacagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaata

SEQ ID NO: 18813 - DNA, 733 bp, Homo sapiens
  ENST00000495108
tcaaatctcataataaaaatctcacacacattcactgcacaaatcctaaaagctctgagctcacagaataattttgaaagagtaagtaaaaaaaaaaattaatttgagctcagatgtgattaccacaaacccgaagtgcaaatatacctaaataggaattaggaattacaaacattgtagaaataaatcatataatgcaaataaaaagtgaacagaaaattactgtttaaaagataaattttttcaactgctttcactaaattgaatctggtatctggcttgcttcttcattgagcatacatataaagttagaattattctgtgagtgacctaatatttattcttcagtactttggtttttaaatttattgcaaattcctctgtatttagaaaatggttatttttccacatgttaactccttacacaaaatgacttttcctgtctacaaaatgtattatgaatatactttctttactgatcttttaatgcaagtatctaaataactgttgtctctattttataggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaa

SEQ ID NO: 18814 - DNA, 743 bp, Homo sapiens
  ENST00000466903
tgaataatcagaagtcagtttgggaagatccagttcttataggactattcatcaggttgtttagttcagcattactttgtgctttctgataagatatgatccaaaacctgatgagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaa

SEQ ID NO: 18815 - DNA, 477 bp, Homo sapiens
  ENST00000467583
tcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctgagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggcc

SEQ ID NO: 18816 - DNA, 581 bp, Homo sapiens
  ENST00000465031
agaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctgggttttgaaaagagaactgggcatgaattcctgtcccagttctgcaactaaatgaccttgtgatttggcacaagtcatgtcacttgtgaagcttcttaatctctctgggcctcagattcctcactgtaaaaagaaaagttgaggttaggtaatttatttggaccttttggctgaaataatctataattctacgactacgtttgttttcatctttggatctcccatatgcacacaaaattggcttttagacttttactagcagaagagaacatgcactgaattttagaacattttctggaggtctggtacaatcaaatcaagagc

SEQ ID NO: 18817 - DNA, 1678 bp, Homo sapiens
  ENST00000264677
aggaattaatcaagcaatggtcaagataaatggagttggccttgatcgctcaggtgtttatgtacaagagttttccagcaagcgtattttagttgtaacattccagtgaataatcagaagtcagtttgggagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccct

SEQ ID NO: 18818 - DNA, 1769 bp, Homo sapiens
  ENST00000616363
aggaattaatcaagcaatggtcaagataaatggagttggccttgatcgctcaggtgtttatgtacaagagttttccagcaagcgtattttagttgtaacattccagtgaataatcagaagtcagtttgggaagatccagttcttataggactattcatcaggttgtttagttcagcattactttgtgctttctgataagatatgatccaaaacctgatgagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccct

SEQ ID NO: 18819 - DNA, 3207 bp, Homo sapiens
  ENST00000315190
gagactagggggcggtgaggagtgggacccgctcgcggccattggttgtgcggccaggaggggcggagggacgacgcgcgggctgtgcggggccggcagcccggatccactcccgctgcgcctgctgtccgccgtgcgcccagactgcgcgccgcgccgctgcgcccaacattcccgaggacggcttcgcgggcgcgtatcgtccagaccggagcaccgccccaccgctagcgcaggagacctgccggggaagtcgcgtgtcctgacctgcagtctcaatgcacatctgatacctgctgcctttgagaaacaagttttgttgtgctgatttaacagcctgtgaattctgcaaacacgatcgtgaaaaaatgccaatctgtcctgtgtaagccctgtgtgaagttttgactttaatctaccagatcactccttcaccctccataaagatgtctgaacctgacacttcctcaggattttcgggaagtgtggagaatggaacttttcttgagctgtttcccacatccctgtccacgtcagtggacccatcctcaggccacctgtcaaacgtctacatctatgtgtccatattcctcagccttttagcgtttctgcttctgcttttaatcattgccctccagaggctcaaaaatatcatctcctccagttcctcctacccagagtatccaagcgacgctggaagttctttcaccaatttggaagtctgcagcatttcctctcagaggtccactttttcaaacctttcatcctgaggaaaatggaagagtccttgagtgtggcagcagttttgacatccccttacggaagtgtcccgtgaggcattgcctcatgaaagaaatgatccttttggtgtagacctgcttctccttctcctttttctctgatttcttttctgttcatgatgcttttcatttggggatggagacaccgatgttggtggaaatgtgtgcaaaccccaaggtgcagaatttcacacaaatggcttgatgaatctagactgggcttcttcaggtaagtcagttcattctactttgttggacgccgtaggctcatctgaggtggcctctccgtggatgctggacatggactcgcacttcatttcttttacaaagccgtgaaatcaactgagcctgcagaaactggcaaaatcaagtctgacctatgtagaagttattttccatatttaaaagataaagtggagacaccaaacttaaaaaggaagagagtcaatttagatttaatgtatgacatttctaaaactgagggtaaatatatgctaaatattttctttaacttcactttaacaagtaaaaatcacacttattgatgaatgtaagtcatttgggaaagttttggaagagtttacattttaatagcaagacaaacatgtattatgatggagcttgtgatgtatttctgcctcctggagttttattttgtttttctgcttatgttttagtcataatgccacaaagttgtggaatttttgtgattaattgctgttactagtactaagagaagcaccagaagagatgccaagaagtttttatatgaataatttctatcagtgagaattaagcatatggaaaatattcatttagttgtattttatacagtaataactcttagctgtcgtgtaagttcctttattcggtttcatagtctttataattttagtgcagaattatattaagcctccaagatgtctgatatttgttcactcacattaggttgtaaaacttagaaactaaattgcaaatatatgtgttattatatactccacgaatgttgcgtctctgataattagttgttgtatgttaacataatactctacattaggatttcaggatgtgagtttgtattaaaaattgtaggcactcaagttgtgtagctgctgggagctttagggatcctaggagctgccgtgctgcaggcagcagagtatgtctgaactcggcgggcgggtggcaggggctgtctgtgaaattaggcacacatgtgagctcagacatggaatgtggaggaactcaagctgcccctaaaaacaaaacaatcaaactgcagctccttaagagtaagaattttaatttaattttgaaaataaatggcccacagggtaaacactgaacttattcaacctacaggaggccactgcatcaacacgccacggtcttcccatggcaactgaatcattccttgttcaaaacatttaatcatcttaagcagtggggcttcaacacaccgtttggttagattgtgcagtcagcactctccagtgattagaatgggggaaagaatccactatttgtacagggtttatctttatcatactaaaatgctgagtgagtggaggtctgggaatgaaaatcagaagtcttcttcttcttttaattcataagcctcacttaaatcagaacacatttaactatttatatatcaaaaacgtccccaaacaccataagaccagcacagagttgctgccctaaaatgtataattagtgaaaaatttacctctgcttccatttaaagcatggcagtgggttgggtgtcattatgtagtataaaaactggactagataaactgctattttagagcattattagcattctctgaatatatgtatatatacatatatatacgcacacacacacacacacataaatatatatatatatatatatatataaactcacatactcccaattaaaagtcgtgtgaaagctacacaggattacagaggcatctatattatcacttttgctctttgactaatcctatgctgtttttgttatagagagaaacaaggacatggatgaagtgatttttttttaaataaaaggacaaatttgccacacaacagaacaatctgagtatgatctgtcctcagggtatctttatatcctttccatgtgaaagagatataaagaattctgacagcaaaactactttaaaaatcaaatcaaatcaaatccacaagcacactcccattcctcccctgccgcaatggttcttgctctcaatgtttagtagagaaattaagagccacattcaaagatggaaaataagatttgtcattagaagcttgccaaggtaacagattgtacaacttgagatgaattcatgttgtttaagaagttcagaaaggttggaagatgggtttataaataaagaagtggagtccattgaaa

SEQ ID NO: 18820 - DNA, 10615 bp, Homo sapiens
  ENST00000428443
cccgggcgcgcgcggggtcgcgcggacgcggctcgggccgcgggtgccgagaggtcgccgggccacccgcacccccgctccccgcctgacgcacggaggggccgggacgcgatttgccgcgagtgactggagccgcagccgtcgccgctgctgccgccgccgcccgggcccgctccgcccccagcccgccttcctcccgccgcgccctccgcctccgcccgcacctcgctagcgttcccctgtcttccccaacgccccggagccgccggccgctagcgtcagcgccagccagaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggtgggagtctcacctatgatcacatggactggttaaataagaggctggtttttgagaagtttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaagacttctttaaacatcttatttaatttagtagttacatcctatttccaaacatgagtgccttatttaaaagggcattcttaggactgtgaggatggtttaatatttgttttttcatggtggttgcatgtattttagacaggaaatacatatgtaagcatgtgtatataataaataagcatgttttatcatgaaaaattattgtgaacaatttagatctttaagaacttattaataatggaatactatttctaatttttctctttttcaacttgaaaaatattctcaaaattattaactaccctgaagatactttgtctttaggggaggagggctgaggaagaaggcatacataattacttcagtgtaatcctttatatcagagtaatctttcaggaactaaaatagcaattgttaataaaatttagtttctcattatagtctaaaagcaaaataaattctgaagtagtccaataacagaactgtatgacccctttagaaataaaatttatcatgaaatgctagttcttttaagtttgtattaagtttaaatggtaaaatgcatataatttaaattttatgtatttttatttcagaacattttttaaaatattaaaaattattttttagtcttgtagtcattacaaaattataaacgagttgtatactggttcctttttgaggtctacaaacatgctcgtgtatcttccaatgcaaaaaaaaaacccctcccttttaacctgctagtttttccagccttcttcactgactgacagacttcttggagaaatccacatccagtgcccctacatcctcatcactcactactcagcaccttgcagtctggttttacacagcactctactgaaactgttcttttgaaagtcagcaatggcctcccagttaccaaactgaatggtttttttctccgtctgaatcccttacccttttctctgcaacatttacaccattgagcaacctttcctagacagtgtctccttccttgaagatgctatcctctgaaataactgtgagtacagtcgcataaccctaatttaagatgtgcctgctgaacatgtgctctctcagatcctgtcctcagaatgcttttggctcttttctcggtatctcatccttagagtttttattttataccaatgttctggattacatacctggtccagaaatctagacttgtacttctttttaattgcctagttgacatttcaaccttgattaaagattgacaatatttatcaccttttcctcctggaacaatttaggttaatggtgcagccttttttcctagtcaaacatgccaggaagttcagggcaaagttcaactgctccctcttgtcttatgtggtcactgcttctgagaacatccaggaagttctttctatacttgaatcatcttctcagtcctttggggctttactgctatgagtatgaacttttgtgattatttatttcagtcttcatgatggtgctatcacattctacagttgtttatgtctgtacccagtaagctcttttgagggaaggaatcttgtcttctcctattcccagtcttgctcatgcataacagatgcccattcctcctaaatatgaatgctgtattataggcattagtaataatccctgttacattgcagtctgaagtatgttttaaacatacttttttaaagttagaactgacttacaagtgaatctattcttagattcttagatactaactactttagatatttagttatactcaataactaaatatcaatactcaatatctgtttcttctgaatttcagagtagttagaatgtttttcttaagactttgctagaaaggaactggtttgttagtaattctgccatcaactcatggagttataattgccaaatgagttaatttttatataccttaagctatcttgcctacaaaaagtaaaataaggcaggattcataaatgttacttgtaaattgagtgtttcacatgaggccaagtatgattttaacataatgaatatcattgctcctcatctgtaaatttgctgctgctttcatatgtgtatctgtacatagagttatgaatgaaaatccagtaatgccctaaagcaactttcttccatagggtcaaagctcacttaaggtaaacgtgtgaaaaaagtgactgcagtgtgtttgaaaccacaagctgtttctatgtcataaattaacatcagcttgcaagtctctgaaagaaccactcatttgtaattggtatatatgtcacaacctcccacattcctttagcccatctcagggaattattgaaacgctggcagggttagtttcattttgttttggtttttttgggtttttttgtttgtttgaggattttttttttcttttatcatttgtttgctcctgtgtaagcttaatatataatggcagtttggcatctgttcttcgcacatgtctaacccagcagagttatgcaaaaatgatgacttcattttaggtcaaattggctttgttcccagtcctcattgttggtcactttgttcagttctggtgactcattggtgatgttgatgaaactgctcagcctgccagctgggatattgatggcaggtctaggcttcattgttaggtagaagattgaatacttctcactttatacaaatttacattggctattgctcccatgtgttagctagtcttaacatgtttgttatttcgttatcttattagctgacatacggagtggtattattagtgtcgtactccttagcgtgagcatgacaattaagttaccttactaacagtgatgagtaaaccatactctgatctaaacccattgttaccaatgatgtgattatgaagttagctgaatctatggtctacatttgaagaaatagttcagaattctctactacattgtaagttacttgctaatagagattgggcattattatgtactactccccttctcacatcctacccaaagtacacaaggccgtagtaaaatactgttgctactaaaaactaaacatactgtggttgctaatgtcctttacatcttcagcctatagggaatggtacaggcagaaacaagcaccattaagtatattatcatcagtagtgagatctgtatgattaggatatctttgcttaagcccccaaaggaaaaattctctagcattaaaaacatggctggaacatagctaagcagttaacctaattagtagacttattgttaacgttcagtcctaaaaatgaaaagcttcagttgggagtagaaaatatactatgctggtatatagagcaacaaataccctgatgagataaaatgaagtagaaacttaccatttgacattatttgactttcatacatgctactgaaaagtctaggtttagctaagaagcataaataatggcagtacttgtagaggaaagaacataccagctaaaacaagaactgtaatgaatataatggaaagtgtttggagcttgaatacttggcttcaaaaatctggctttgccatttactgttaaaaaaatatctgagaatttatctcaggctgtaaaacagagaagtcataccaatttcaagaataaaatatgatataaagaattgttgaagccaaaatatccagaaataaacagaatggaaggtatcattgctataattatcttttcagaataaaaaatagagtattctttatcctttctgttgtctcacatgacaagcatgggatggtgaggaaatggcatattgcctatgttcgccgccccacccccttagttccaccaccccttcaccgtcacccccagttcactagtgtatcagaatgcatcttcagaattacacactgaagatacaaaaggtccagttggtaagctcatcagtaaataacaaggctttgaaatctgacaaattagctatttttgtaggaagataatagaacagcaagatggaagacaagtgatgagtatcatctgttttgaggttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggcacatttttaaagattttttttggagaactttatgaggctgtatgtataattcctatatgtaattttataggaattcttaactgaaagtagttatcaactgctacttatcaggagcagtgttattagggattttaagttaggcatgtagaaaactttctgacaaaagggctattgaactccagccagttcccagtgaatctccaggaggcaccttagaagtcttcacaagctgaataccatgtctttagggtgtccaaatgcttctgtcttgggggagagatgagagatgactgggtgcctttccactcagaacacagtagaccactcactatttatgaccaagcctcacttcttttctattacagttacagattcttttttagtctggaagttagggtaaataaaatttgtatgtttgatttttctcttaggaatgttttctcatcttaactcttatgttatctttatggccaacagatttgctcagaatatatcatcaaaatatatgtattgtattttgtaaaggtgaaaggatcgaaataccactttgacagttataaaccagagtagatttgagaactgattgctcacatcacacttacgaatagtctcagaagcctttaagagaaacttacttctcaatggacacttagaagaatttgatgatcttactgtcataaaatcagtaatgaaattctcagcaaaactatttggtaaacattgcaccctgtatttttacccaacatcttgttatgaaaattatcaaatacattaaaaagttaaaataattttatagtgtactcactacctagatgctaattagcattacctatgcttgctttgtcacatatccattcatcatttcatattattatttgatgcattttaaattgcatatcattaactagagttcattgttggcttttttacataaaattagcatgcaatgaagtgcatagaaatatgtgttcactgaggtttggcaaatgcatatagtgctatggaaataggaaacgttatcaccaccctagaaagtttccacactgccctttccagtcaattcctgtccctacttgaccctcaaaggcaaccactgttcctttttctaccataagatttttctgttctaaaactttatataaatagagtcacgcaacatgtacgcttttctacaaggcttcatttttttattgctgttcttttttattgctgagtagtattccactgtatgacaatattacagtttgttttcttaatttcctattattgatagatacctgggctgtttccaggattggccattataaataaagctgctatgaccattcttacgtaagtctttgtgaacataggttttcatttctttgcagtaaattccttggattagaattgctgggtcacagggtagttttaaaagaaactgccatacctttttccagttcagttttattgtgccctgtattttgtattttgatgtgcataaaggtgtaaactatttttatgatccatattgaagtattagaagaagtgagtttggaataacaatggcattgttcatggtcaaggatgacaattggaactatctgaggaaagcaaagacctgtctgccccagacagctcctcaaggggttcctatgcctgaaactttagcaatatttcactccttgaaaggttaaagcccaaccatggtgatatgttagctagaagaaacagcactggtttgtttatgttactaactttcaccacccgttttcagtaggtaaagtaagactgatcattgaacagaaaaggttatttctgtgatgaggttgagggggtagtggaaagcatgtattgctagtaagccccaggtacagctatgtgagagagagtcacctggacagggaagtcccccaaatggtggccagaagagcagaaaacggggtgggaaaaattctacctcacagttttgcataggggatagctatgcttttacgggacattttagcgtttaaaaatattttcaatattgtctctttattcaataccacccagctgtagttttttcacactctgatgactctcttatccactcttttacctctcccagctgttctattacatacagcattcacctgtattagtctatagaattataatcatctgtgtgtttctaatgctcattttcaaaaatatgtatggtttattcgatttttcctattaaaattttaagggctgggaaatttggcttctactgtaaatccttataatgttccacacattgtaaatatgcaataaaaatgttaacaactataatggcagcaggttttggtatgtatttctttgatatattgtcactttggacaataagtttgatttctgttaataaaagttgttcataaaatctagggagaattaagtcacactggtctctataagataatctgatgaattctgcatctttgaatcaatttgagttattttttgtaaaggtttaaattgtttctaacagtgttacctaaaacctttcattaaatcaaaaatgtaacttgtatattctgaaataacctggagtcttagaagacagaggcttctgcttccctctcccgtgaccccaacaatcccttcccacaggcttggcacagaagttcagtgctttctctacgtctcatgttgtcagaaataggttctcaccataatagacagtggtgaaatttccattgttcctactgagaagtccatttttaaggcatcaaaggtgaatgtgtatttagggatggaggaggcatattacaacaaagctgtatttaaaataacacaatcatatcatgctataaacaatagcagttccagaatggctactaaggattttggactgccagactttggaaattggcaagccttataccttgtccaatgaagttaagtacatttgagtgacagttcaacatacaagcaaaaaaatatatagaagacattgtacatttgttattaatggacatgtttactttacatgttagagtatccatccatctctaggttttccattagatgcttcattgtatccacaaacctgtttcaaaccattgaagtgatcttaccattgtgtttgttcaaaataaaattgggagaaaatgtgaa

SEQ ID NO: 18821 - DNA, 1699 bp, Homo sapiens
  ENST00000446758
tgcagcaacaacttagtgatgtttgttatcgacaggccagtcagctggaatttaggcaaaatctcttacaagcagctcttgaatttcatggtgttgcccaagatttgtctcagcagttggatggcttattagggatgttgtgcgtagatgtagcaccagctgatggagcatcgattcagcaaactttaaaactgcttgaagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacaggtgcaaaactggttatcttccttttccacaagctcagtgtttgaatagctttctgcatgattataatgtaactttaccttccaagtacaagaagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataatgtattaaaagttgtttgtgcttaataaaa

SEQ ID NO: 18822 - DNA, 1675 bp, Homo sapiens
  ENST00000335289
ttacaaaggaatctacatcattattagatgaacttgctttgattaacaatggaagtgataaaggaaatcagcaagagaaagaaaggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtagagaagctgaaaagtgttgatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatggaagatatgcagcttagaaaacaaagatgtgaagacatggtagatgtgcgaaggttaaagatgcttcagatggtgcagttgtttaaatgtgaagaagatgctgcccaggcagtagaatggctaagtgaacttctggatgctctgcttaagactcacatcagattgggcgatgatgctcaagaaacgaaagttttgctggaaaagcatagaaaatttgttgatgttgcacagagcacttatgactatggcaggcagttgctacaggccacagttgtgttatgccaatctttgcgctgcacttctcggtcatctggggatacacttcctcgactgaacagagtatggaaacaatttacaatagcatctgaagagagagtacatagattggaaatggctattgcatttcactcaaatgctgaaaagattttgcaggactgtccagaagagcctgaagctattaatgatgaggagcaatttgatgaaattgaagcagttgggaaatcacttttggatagattaactgttccagtagtttatcctgatggaaccgaacaatattttgggagtccaagtgacatggcttctactgcagaaaacatcagagacaggatgaaactagttaatctcaaaaggcagcagctgagacatcctgaaatggtgaccacagagagctaatagctaccagctacctacagatttgcagttcataatcccgcatgttgtcaacatactacagcattagccaccacaccttaagatgcatttcacagccaaaataagtctcatttcttttcatgacacatttctctttacatgttaacaccttgctactaccaaggcataattacttaacatgcttcgaggctgtagattccaagtatcttaaaagaaggaactataaacattgcactgaaaacttgctttaaagctttacctgacctgtcagtttgtagacaaacaactgataataagctttgaatggtgctaataagagtaggaattctctctattaaaaagaaaaaaaaaagttgcccttcctccacaggtgatttagtaaatttagacagtagttaaactcttgttagtagacagtggtgtcctcaaaattttactttgtaattcttcagaattgattatttttattgtgtcaatacagagaaagcctttcagatctttgatatatcatagtcattaaaagaccttttcctatttgtattgataa

SEQ ID NO: 18823 - DNA, 724 bp, Homo sapiens
  ENST00000426988
aggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgaatggtttgcagtgtatgtggaacttaatcagcaaattgcagcactcttgaatgctggcgatgaggaagatcttgtggaactaaagtcactgcagcaacaacttagtgatgtttgttatcgacaggccagtcagctggaatttaggcaaaatctcttacaagcagctcttgaatttcatggtgttgcccaagatatgtgggattgcaaggtttgcgtgaaaaaggtcaaggtctcctggatcagatctccaatcaggcatcctgggcctatggaaaggatgtaaccattgaaaataaagaaaatgtggaccacatacaaggagtgatgga

SEQ ID NO: 18824 - DNA, 652 bp, Homo sapiens
  ENST00000489901
aggtctgtggatttaaactttcttccatcggttgatcctgaaacagttcttcagacagggcatgaattgttgtccgaattacagcagcgtcgatttaatggctcagacggaggggtttcatggtctcctatggatgatgaacttcttgcacagccacaggttatgaaattattagattcactccgagagcaatatacccgctaccaggaagtttgtaggcaacgtagcaagcgcacacagttagaagagattcaacagaaggtaatgcaggtggtgaactggctagaagggcctggatcagaacaactaagagcccagtggggcattggagactccattagggcctcccaggccctacagcagaaacacgaagagattgagagccagcacagtgtgagaggctttttcctctgcaagttacaatgatattatgaacgtgggtaattagtagcatatgtggtactgagtgataagttgctgcaaactttggtatggggcatgaagtacagtttgttaagtgcctagaggtcataaagtacattttgattacttagtacatgttaattagaaggttgtttttggttttgtctctaatgcagtttaattatatttttatagaagcacaatttgcatgaaattttaaaagctacag

SEQ ID NO: 18825 - DNA, 619 bp, Homo sapiens
  ENST00000440010
agacaaagcgccggaggtgggagccctgcgggccgcctttgcctccgcgccgtctgccgggtgcggccgcggcccgcagagaccgggccgcgcgcttttccgttcctgagcgcccttgttcatttctgggtgaaagggacccgaattgtgcaacagaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaagattttggt

SEQ ID NO: 18826 - DNA, 681 bp, Homo sapiens
  ENST00000435047
ggcccgcagagaccgggccgcgcgcttttccgttcctgagcgcccttgttcatttctgggtgaaagggacccgaattgtgcaacaggtttgggcgttagtccttattttccagcgggtctcttttgccagcgtgcaggaaccagatgtggctccctgctctcgggcgagtcccgcgtccagcgcccgcgactggctcctttgtgtgaccggtgaccggccctgtcggaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggttattttagtgtccgccaacaaattgactcgttatatagaaccatgccaattaacagaa

SEQ ID NO: 18827 - DNA, 423 bp, Homo sapiens
  ENST00000486468
aattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagaatgttgttccagctgaggtgtcccttgtttgtgtggtaaagccagatgaattctgggataagaaagtaacgcatttttgtttttggaaggagaaggatagacttggctttgaggaggatattttgtaaaacttgattttgga

SEQ ID NO: 18828 - DNA, 460 bp, Homo sapiens
  ENST00000452991
gggcccgctccgcccccagcccgccttcctcccgccgcgccctccgcctccgcccgcacctcgctagcgttcccctgtcttccccaacgccccggagccgccggccgctagcgtcagcgccagccagaattaaggaagttcactggagtaaaatggaggcctcagtaatattacccattctgaagaaaaaactagccttcctttcaggaggaaaagacagacggagtggcctcattttgacaattccattatgcctcgaacagacaaatatggatgagctgagtgtcaccttagactacctactcagcattccaagtgagaagtgtaaggctagaggatttaccgtgattgtggatggcagaaaatcacagtggaatgtggtgaaaacagtagtcgtaatgctacagatgagctgtttgggacttgctgtttgaactggactttgatcagtggcagtttt

SEQ ID NO: 18829 - DNA, 1785 bp, Homo sapiens
  ENST00000426838
aagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatggttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacagattaaagactccagtaaggaggaagtctggaagagaagaggaggccaaggcatcccattcaaaaagcaattcctgtcccaggaacgtgccatgtgcttctcatgcccccggaacccattccccgcaaaacccggttctctcactcttccttttcacagtgaacctgcagtctgggcacaagaagtataacttcgcatggattctgcaaagcccacacctgtggtcattccctgttctttccattcaacaatggagacttgcccaagattgtaaactagtgagtgacagcatttgggcttatgatcttctctgcctgctagctagacattctctctgggtctaaaagataatccaaaaagatccagcttcacaatgctgccctgaagagataatgcattaggcggccctgatgcagcattcactgtcttccagggcaggcttgatcccatgagtttgcttgctcagacgatcacttaggaaacacatgcctttactctctaggccttttttctagcttgccttgtatcagctatgccatggatctttgctctcttaccccatgctatacagagtatgggctccaagccacagctggcctgtcaagtgtgtgtcgctggtccaccatgggatacatttagaaacttttatagcaatttgacatttttgtgatatccaagcatgtgattgttttcctacggatttgtcttatagtattttaccaaagtttccacacaaaaagtatggattaaggacaaagtatctggtccttcatcaaagatcgtttgataagctctgttctagttaaccaacactgagctttcctagttttaataaaagagtaggatttgga

SEQ ID NO: 18830 - DNA, 9899 bp, Homo sapiens
  ENST00000282030
ggttaagtggagctagagagctacattgtaacctagttggatttttttggggggggaatgtatcagaatctaacgtgtcgttaatagaaagaagaacaggcaagaagtggtccagccggcgaagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacaggcttacgagaggccccagaaacattcaactctccattatgacacgggcctcccacaggacttcaccggtgacaccttaaaaccaaagcaccagcaaaaaagcagcagccagaaccacatggactggtccaccaactctgacagcggacccgtcactcagaattgcttcatcagtccagagtctggcagagaaactgcaagcaccagcaagatccccgctcttgagcccgtggcttcctttgcaaaggcccagggtaagaaaggcagtgcagggaacacgtggagtcagttgtctaacaataacaaagatctgctcttgggaggtgtggctccatccccaagcagccacagctcaccagccccacccagcagctctgctgagtgcaacgggcttcagcccttggtggatcaagatggaggaggtacaaaggagcccccagaaccacctacggtgggcagcaagaaaaagtccagtaaaaaagatgtgataagtcagaccataccaaacccagacctggattgggtcaagaatgcccagaaagcatttgacaatacagaagggaaaagggaaggttattccgcagatagtgcccaagaggcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcacacgcttggagcagcttccccattcatgaggccaacagtgccaccacctcagttccacacaaactcccacgtaaagatgtccggtgcagctaagcataaagccaagcatggagtacacctgcagggacctgttagcatgggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcagagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccagggatgccaagtccccacttaaaagtggaccagacagcagtgcatagtaagaacgaaggctcagtgcccaccatgatgaccaggaagaagccagccgcagttgacagtgttacaattccaccagccccagtgttatctctccttgctgcatctgcagcaacgtcggatgcagtcggctcctccctgaagaagaggttcaagcggcgggagatcgaagccatccagtgcgaagtgcggaagatgtgcaactacaccaagatcctgtccaccaagaagaacctggaccacgtgaacaagatcctgaaggccaagcggctgcagagacaatcaaaaacaggcaacaacttcgtgaagaagaggcgcgggcgtcccaggaagcagcccacccagttcgatgaggactccagagaccaaatgccggtgctggaaaaatgcatcgacctgcccagcaaaagaggccagaagcccagcctgagcccgctggtgctggagcccgccgccagccaagacaccatcatggccaccatcgaggcggtcatccacatggcccgggaggcgccgcccctgcccccgccaccgccgccgcccctgccgccaccgccgccaccacccctgcccccgccaccccctctacccaagaccccccgaggcggaaagaggaaacacaaaccgcaggcccccgctcagcccccacagcagtcgcccccgcagcagccccttccccaggaagaggaggtgaaagccaaaaggcagaggaagtcccgagggagtgagagcgaggtccttccctagggcgggtctgggcgtctgcacctggggcctagggaactgacacgtgggaagcgcagtgagccggggcgggggcggaatcccccgctgcagggacacccacgcccttctctccagaagccgggcaggcagaatccggccagacgacggggctgagccatcaggagctcttgggaaagcaaagcagggagacaccttcagaagaagcttgtctgagcttcaccgcagctcccaccacgcggcgcttcagtacggctggatcctccgcaggcgagcggaaggcccccaggaggagcaggctggtggcactctcctgacctcacgctgccaaggtgcgccctcgactcccgatttcatttgctggccaggaaaatcgaaagggaaacaccctcaattaggaaacattccaaggggagaaaagctgcaaattgctcaactggcattgctgtaacccgttccatttaattggtttttatttcttttgattttcaagctctgctaagctttggggtaccaacgtcatcttcaggtgacctgaatctttcccttaaccgtacagtttctcgatggaattgtgtgatcagaaggtggaattctagtgataggcgacctcagacccgcattcatgttctgtgtgcctcttctattgcacatacactgatttttagcattgtctattcctatttttcctttgcccattgtacttccatatatcttttcattaacttacttgctgccttttttttttcttggtacacatttaaataaagtaatccttaacctgtgctgtaaagttcacccttggcatgctgttccaagaacctgggtttgaatcccaatcgttgtgaaacatactcagtattgataaaacctttttaataagtgatgcagagcagccaaggatatgttgacccagatgtcaaccaggctatttttatacttaaaacatgtcagcagagcataggcagaataaaatggtttaaataccccacagcaaatagagtaactgacaaaccaccaaaaactgaaaccccagacccaccagaaagacaagtgtctagcaatgccttggtacctgatctttttcattcaaataattgtcataggttgttcaaaaaaaaaaaaaaaaaggaaacaaaaacacaatagaagtccattatcccttgataattatttcttaaaagcaaatgggagtaagtgttcttatctggaaaaataaataaataaaatgctcaaagggtatcaccacttcaattttatcaagccaccttggacaaagtatccaaattgtggttgccttaataaactaaaacattattgtacataatgtaattataaatctatcagtctgcatggatgcaaactgtgtgtgacaaatcgtcttttaaatggtcaatttcagctgtacatttctcatccaagttgtactctagccattggtttagcgtggacagatactccatctctattatccatttccacagcccaaataaaatatgttaagcaggctcagaatgaatatgaagaattccatttccgtagatgttttctaaaagtcagattgtggaaatttcaaataagtattttcaatttcctccctcactccctcttaccttccccaagacatcaaacacctggcatggtagattatagaaagagacactgagagagagaattaaattttctaatgggaattagaatatctggtttacctccaaattaagtttctttacaggaagttgggaccagctggaaattgtattatcatttcggaacacaatattacttccttagagagagatggatttttgttggcaacataaaagaataagtgatggggtatctatgtgagtaaatttttaaattccaagttaatatgcttgcaaacattactgctgcgttatggcaccaagagttggttgaaattacccacgtagtcatactcctgtgctctgtcaccatggacttcacatcatttgctgcccactagttcaatcgcatttaatcctagcaatatgtaagtttaaaggactgcattcccctctactttaaagcttatatcctagatactcagtttgtgaccttggttgacctttggcatttcacgcaagttgaacagcaaaatcaaagcagccatttttaattcgtcattcccaagccctatctgagtggttccaaagtcacctgagaggaaggtttaaattagtccctctcaccccaccattgctataaaacagcaacgttttcattccaattcagccataaagaggtttctcttcttactgggttttgaaatcatttccttttttctttcgtttgcccttcttccttcctgtgttgtactatctctccaaccacgtctataagcagactcaatcttcttgcagaggaagatgagctggcactctgcaaacttctttaataaggacccaaagtttacttgacattaacctctagtaggtgagaaattccaaaaaagctttggggtacattagaatttccaaagctctgaaagatatttcaggagatttaacagcagagttgcaacttacacgtgaattctggtctatagtggtcatgtgagttaaattcgaatcctctacttgtatgaccctaggaatagattggaatactgcagaggaccaaagctgaggcatgctaaacagctgcttggaggtggaagcaagttcagtcacctactcagcttcctctctccaccacccagttcctccctcagtatcacattatttttttcttctgcttttcattaacctaactcatctcatcagtacaaccattttcttattctctaactacccccaattcctttagcctctccccacctgtccaaactcagctcagccgtgggccaatgcagcttacagacggttgcagagctaggaagaaaacccagctctcccaaccctgatcgtggaggtctctggccccccaacactgccttctgggggctgcattttttttttttttttgagaagaggtcttttgggatgcatggtgctccacatacagcttcacaaaatatttcattataagagaaaccccttgatttttatttctttttcttttgttttctggattacctgccttcagtaagcagatgcagacccacttgtaaggagtctggttagtgatgagaaaaggatgaaatctagatacaaaagtcaccttgaaggtgatgatggatctttaatccacttgactaagtgtctggaagagctacttgctcttccacccctcatctcaaatgagaggagcagaagtttaacttcctcaaatagcccagctctggctaaaacccaaagaagaaaggtcaaaggaagggaaagcatgtcaggggctggtttgtgacttggcaggaccaggaaacagcagccactgacagcccagagaaggtgactaagggctggcagaagattagaatgttaatttggctgctgtccggactaggaggccatgttcaatggcagtcagaatttgtgttctgcgcattgctgggtctataaatatgataagcaagtggtgacagaattatagtataaggtgatgtactacatgcagatcataaaggctttggttttaagacttaagtagaaaatccctctcctagcttattacccaacaatattcagataatgagcttttggagaatatctttttcctatcactagaaagatttacctgggaactgtctaaagtctacacacatatttccaaagcctttaaataccaactgcagcatggagagagaggggtggcagaagctgaaatgcctcaaaagccatttaagtgttacgttgcaggattttcagtccttctcgttatgtaaaagtagataaatatagacgttattctcaacactaccctatagtatcacagtggtccaaatgccagagcttacagataatgtcatcacagtgcctagaaactcgaactgtaatatatcgtagcattttcttggtgtttcttaaagtttctttccacaatacaaggtcctctctgcctcttgtttcttggagagttcaccccactgatgagtcttccttccctgttggactcagtcatttggggaacagtcttagaagcacatatcaaccaaggaagaaacttcctggatatctattgcccacttgcccaggtctaataaacactaaaggggggaaattgaaaggagctgccaactggtcaacgtggaagggcggttccaccctagattggtgtctttctttttcttcctttttttaaaaaaaatctatttcttaaataataataaatgcacatgatgtgttaaatatgtacatatatatttcaaaagaaaaaatggggcacaagattgtcttacaagtcgtgctggctaatttttagtttgtattcataagtggtttttaaaagccttttttaaagtgtaatttgcatgttctactttgattgtatgtaaacatattttagaacaaaaaatgtatttgtattttattgaatatagaggcaagaaaattgtacattgtttgaaatgttctttttgtaacagtttttattcataaagcatttttgtacatttaaaatgaacatggacttgctgttatttgaggcgtagatacatctagcatgcttactgtcatgctcctccatggtcttagatgttgggttttaaacatttttttctaaaagaaagctcagtcttttccgctaccagatcaggttagcacagtatagagcacttaactattaaaaaaaaaaagttaatcctattcatatgttattcattgtgtgaaattaaagacattcaattcagtctaa

SEQ ID NO: 18831 - DNA, 762 bp, Homo sapiens
  ENST00000591940
gcgtgagcctgtgcgtgtgctcacacgcgcattttggcagggctgaatcacaagaggactcgcagttgatacccagactcaccaaaaaattgagctgtgaatttggggaggcaggtacgtgctgggaaggaagctaaaggagaacaacagctttgtgtgctgatgaagtaaacagacagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggg

SEQ ID NO: 18832 - DNA, 3015 bp, Homo sapiens
  ENST00000346932
gattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaa

SEQ ID NO: 18833 - DNA, 3173 bp, Homo sapiens
  ENST00000350527
cggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaa

SEQ ID NO: 18834 - DNA, 3801 bp, Homo sapiens
  ENST00000308713
agcttctccctcccgcagctccagtgcccgagcttcggctctcccagttccccaacccaccccttcccctccccgacaagccccgctagagcccagtggagaccccctcgatcctcgaccccaccctaaacccccagaagctgtctttctcctccccagtcccctagcttggggtccagacagcccagtggacccaggcgcctgagcaggagggtaacccaggccacccggccccttcggccctctcggccccaccccctgcagccggagccgcgccccctccaccacagagccgcgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaa

SEQ ID NO: 18835 - DNA, 909 bp, Homo sapiens
  ENST00000563118
tctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcct

SEQ ID NO: 18836 - DNA, 1068 bp, Homo sapiens
  ENST00000568407
tgccactacttgctctgtgaccttggacaggttacttgatctttctatgccctaatatcctcatctataaaataaaggataataatagtgtctgactcaagagttcttgtgaaaattaaatgagatagaatgtgtaagggcttagaagagtgcgtggcatatagttatgtgtgatgataacagctataaaaataagttaggaaagcaggcaaggggtgaggcagcttgtgagggagattgagctcctggtcacgtttctgtccatcccaggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcac

SEQ ID NO: 18837 - DNA, 764 bp, Homo sapiens
  ENST00000562159
gtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatgg

SEQ ID NO: 18838 - DNA, 332 bp, Homo sapiens
  ENST00000568380
aattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgacccc

SEQ ID NO: 18839 - DNA, 3423 bp, Homo sapiens
  ENST00000537485
accacagagccgcgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgt

SEQ ID NO: 18840 - DNA, 3555 bp, Homo sapiens
  ENST00000617533
accacagagccgcgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgt

SEQ ID NO: 18841 - DNA, 2085 bp, Homo sapiens
  ENST00000271628
atgcaattaggacgaggtgagcgcagacgtcactctaagctcagacatttcgcagtctcctcccctgagggaaaaccaaatacctccagcccaaatcagggttgtgaggccaaatctgcaagaaggctgcaggcgagagggaaggctccctctgcgcctgaaagcccccaagtcctcgggttggggggaactcttcagcacatccttctctggacaacagaagaagaatcactgtccacaaaatatattaaaactgaaatttttgttcttttagctttcgaatttacacttttgagagcagtgtgattctttcaagtctagcagtgcattaagagggcctgagcgtttccgttccgccctcctcgctaagacaactagcagcggcacctcaggacgcgagccgaggactctaccgcccgacccaggttaagtttcggaggctcctaagatggctgcagccgcttccaggcacctcctcttccgcggccccgcccaccgctacgtccgtcttcgccccggaagtggaagtcgtgctgaggtcagaaggcggaaccgctgctgggagacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 18842 - DNA, 826 bp, Homo sapiens
  ENST00000457312
ttgggggcggggtggccgggtgctggctgaggcctctgggtgtgatacttaagtccggtcccctgctgacttctcactcaaaaaatcaaaaaaacccactcacaatactaaattagacttcagaggattcccgaagtcctgggaagagagaagtttaaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctc

SEQ ID NO: 18843 - DNA, 4072 bp, Homo sapiens
  ENST00000474528
ggggcaaggttgggggagctgccccttgtcctgcacttcagcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagca

SEQ ID NO: 18844 - DNA, 3578 bp, Homo sapiens
  ENST00000461352
cctgctctggggcaaggttgggggagctgccccttgtcctgcacttcagcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgccctgctggagacggcgctgacgcgagtggtcctgcccatgcccatcctggtgctacccccgatcgtcatgtccatgctggagaaattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagca

SEQ ID NO: 18845 - DNA, 4140 bp, Homo sapiens
  ENST00000272433
aactacactccccacaacgccttgcgcctcccgctcgctgcggttgattagggccaatcgggagaggcagctgtggcgggggccgaggagggacattttaaaagggccggagattgcgggcgtcagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagca

SEQ ID NO: 18846 - DNA, 808 bp, Homo sapiens
  ENST00000495208
gatttgagggaaatgtctgattagtagacaggccccagaagctgtgaggggcactcgcacgcgaccaaggcacctgtttccaagcagcttgctcaggatctggcataccccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaaattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggc

SEQ ID NO: 18847 - DNA, 906 bp, Homo sapiens
  ENST00000490056
gtttaattctggctgtacacgtcaagagtagctctgataagtggtaacgccataagagtgacaggatcttctgaaaaaaatgagagcctgttattggaatgagctgcctgactcctggatttgagggaaatgtctgattagtagacaggccccagaagctgtgaggggcactcgcacgcgaccaaggcacctgtttccaagcagcttgctcaggatctggcataccccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctg

SEQ ID NO: 18848 - DNA, 895 bp, Homo sapiens
  ENST00000482289
gtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagaggaggaagaaaaaccatcaagaaggggaagaagcagccaagggcacagggagaacccagatggagtaacttcatggaagctgaggacttgggcgattcaaagaggaggggctgtctccagagtggattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctg

SEQ ID NO: 18849 - DNA, 915 bp, Homo sapiens
  ENST00000411783
ggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtaggccctgctggagacggcgctgacgcgagtggtcctgcccatgcccatcctggtgctacccccgatcgtcatgtccatgctggagaaattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgaccc

SEQ ID NO: 18850 - DNA, 840 bp, Homo sapiens
  ENST00000410065
attgcgggcgtcagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtaggacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtga

SEQ ID NO: 18851 - DNA, 546 bp, Homo sapiens
  ENST00000482542
agaatggagagagccaggggcaggcagggtgggtgttccagagagagggcaccgtacaagcagaggtgcacaggagagcatgaccaactccgggctcagaacaggagggcggccaccgggtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaaaatgtcatctccatgaggcacgtccatccttttgttcactgccctgcccagcatctagcacagttcctgccacacaatagatgctcagacggctctcctgcaggcacgcccccggctgctcctccctgtgcaaa

SEQ ID NO: 18852 - DNA, 575 bp, Homo sapiens
  ENST00000463277
agcctggctgcgcttcaccccagctccctactgcgccactggggatgccacggatttaagaagctctggcacttagaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaag

SEQ ID NO: 18853 - DNA, 895 bp, Homo sapiens
  ENST00000416579
ggagattgcgggcgtcagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagatgcctgcagcaacccctgacccctagatcacaatcactgaaaatgccctcaaacatggccaaatgccccacagaaccgcccctggcagagagcggctgtttagggcaggtgagcatgcctgttgtggggcaggagagcccgggacacagagggactgcccatggtttccactgcactgagcgtcggtggaagcaggagagatgctcgaagatggtgtgtgtgctctaaatacattttagaactgta

SEQ ID NO: 18854 - DNA, 532 bp, Homo sapiens
  ENST00000464825
accaacctcccagctttcaccacctctcaagtacccgggcccttctgctgagcctcacggtccaggggcgtgtgaagagtttaaacagggagactctcctcccatttcccagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgcctt

SEQ ID NO: 18855 - DNA, 2975 bp, Homo sapiens
  ENST00000450185
ggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagatggagtcttgcactgtcccccaggctcactgcaacccctgcctcctgggttcagagacgtctcagagaggctgtgcagctgctggaggactataagcatgggaccctgcgcccgggggtcaccaatgaacagctctggagtgcacagaaaatcaagcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgagtactccctcccctgctccttcttggctctgctgctctggggccaccccgctcagcattgcaggtggatgcttgtctgagggccaggccaggcaaggatttgggagacaggtttctgtgggtggaggagtcaggacaggctttccaagccgagaagaggctccagtagacagagcacaacctggtgctccctgtaatggagagcaggtggggaggtgaggttgtgcctgggggcactgaggcaggacatctgtcttgagtggggctgcggttgcccagcactctgctcggaagagctgctcctcatgctcggtaacgtggctggagcgagcggggtggggggatgcctctgaatgactctgcaaggcctgcccatgtgcctgctcccctgagctcttgctcagctgccggggcactgcttttccctctctatggccttactggtgtcacacgtccagctcttcctgaagacctgtcagtgcccgaagccaggggcgttaggctcactctgagtctccacagtactttgaggccagagcagctactcagtaggggaggttcagagactgagcgtgagggtacggcaggtgtggctccctgcttcccagaggaggccaggggcaagtgacacagtcagggccctgggccagagccagagtggacgctcaagctgccaggaccttctgcatgcttgtcccacccctgagcccgcccctgtacctacgtctggctgtctctggatccccactaggatggccttctatagccgactccagagggcgaagggccccttcacaactctgtcatttcatccattacacaatacattaatgtaactggtaagaaaaaaaaaattagaaaatgaaaaccaaacaacattcacatagctgagcacagtggggcacacctgtagtcccagctactcaggaggctgaggtaggaggatcattgagcccaggtgttggagtctgtagtgtgctatgattgcagctgtgaacagccactgcactccaacctgggcaacatagcaagaccccatttaaaaaaacaaaaggccgggtgcagtggctcacgcctgtaatcccaacactttggaaggccaaggcgggaagatcacctgagatcaggagttcaagaccagcctggccaacatggtgaaacccctgtctctactaaaaaaaatacaaaaattagtctgcatggtggtgggcacctgtaatcctagctccttgggaggctgaggcaggagaatcgcttgaacctgggaggcagaagttgcagtgagccgagatcacgccactgcactccagcctgggcgacagagtgagactccatctccagaaaaaaaaaaaataaataaataataaaaaatttaagaaattaaaaaaccccaaaaccattcagctgggcaagctggtgtgcccctgtaatcccagctactcaggaggctgagttgggaggattgcttatggccatgttgggcagcatagcaagatcttatctctaatgaaaaagaaaacattcacatataatgaagaattcacatacaataaccttttggtaaaaccccctttgctcatctttccagtgccattaagtaaatactgtataataactgttcacggctgtataattacccattgtaccatacgccacaatttaattcaccattcttctaaaggagggacttggggttgtcctgaaatggcctcatttatttcactcccacatagaccaagtcatctccaaatagctgtgaagtgggatgtcccatttcatgcccaagatctctttcccaaatccttatgtcttcacaaaagcaagaagtgagacattcaggtggctcaccaagagactgctgacctgccacccagcttgtcctgcagcccagcaggagacttcatttgggagtcagacaaattgggggtccctgatactggggacttggtgggtgaaggccaaaggctcccctgagtgggagaaagaactcttgtcacctcctccttgttccttgtgatgagaggagctgatggtctgcttagcttagcagctcaaaaatccccttcctttttttgagactcaggggcaaggtgagaggaggaggctacatagggaaggatgctgagtggccttgaatggaaaggcctgagtgaaggggatcattgtcctggtggacttccttcacctgcaggcctggggctcagagaacaagaatcagcttctcagcctgagtaacatagcaaaaccccatctctacaaaaaatacaaaaaaaattaggtgtggtggtgcacacctgtagtcccagctacctgggaggctgaggtgggagaatcatttgagcctggaaggtcgaggctgcagtgagccacgattgtgcccctgcactccagactgggcgacagagcaaaaccctgtctcaaaaaaaaaaaaaaa

SEQ ID NO: 18856 - DNA, 489 bp, Homo sapiens
  ENST00000442582
gattgcgggcgtcagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggttatattccttttgggacgccaatttcggtcttctcttgcccaaccagacactggcatccactgtcttctgtggctgaaccagagccacaatgcctgtgtcaactatgcaaaccgcaatgcgaccaagccttcacctgcatccaagttcatccagggatacctgggagctgtcatcagcgccgtctccattg

SEQ ID NO: 18857 - DNA, 507 bp, Homo sapiens
  ENST00000487508
ctctggggcaaggttgggggagctgccccttgtcctgcacttcagcagctacagggctgtgggtgaaggagggcctgaggattacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtct

SEQ ID NO: 18858 - DNA, 598 bp, Homo sapiens
  ENST00000497144
ttggccaccggcggctgcggtcaaggtcccgagcgcccggcttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggc

SEQ ID NO: 18859 - DNA, 1808 bp, Homo sapiens
  ENST00000479293
ttcgagcggctgctcagggtcgctccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcagaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtaagtgttaccttcaaaggatttccttttctaaaaaattattttaaatgtctaactttatgttattgctcacgggtatttgactgaattgttgatttaggataagtcaattcctggagggaaattaccaaataaaatgatatgtatttcttaccacatctcttgatgctgattggcaaacctcttttcataaaaagcctgatgacttaaatccagcgttgagttgaaaattgccttcttccctgcacgttttctgtccccactgttgtcattagcacctgctagtcatagggaagttttctcaaagaacttgggaagtaggagtagaagcatgccttctgaaaaatcaaagtttaaaattaattcagaaagaattttcagcattctttttgttcagttttagaatcaggattatgtttactccttatttttattggaataaaacatacagaaaggtgcattcatcataaatgtacagcttggtaaattttcaaaaagcaagcatatccagggctgggcgcggtggctcacgcctgtaatcccagcactttgggaggccaaggcaggcagatcatgaggtcagaagatcgagaccatcctggccaacacagtgaaaccccgtctctactaaaaatacaaaaaattagctgagagtggtggcgggcacctgtagtcccagctactcggaaggctgaggcaggagaatgacatgaacccgggaggcggagctttcagtgagccgagatcgcgccagtgcactccaggctgggcaacagagcgagactcggtctc

SEQ ID NO: 18860 - DNA, 447 bp, Homo sapiens
  ENST00000485057
catgtgcaggagctggagagctacatcgaccggctgctgacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtaagtgttaccttcaaaggatttccttttctaaaaaattattttaaatgtctaactttatgttattgctcacgggtatttgactgaattgttgatttaggataagtcaattcctggagggaaattaccaaataaaatgatatgtatttctta

SEQ ID NO: 18861 - DNA, 422 bp, Homo sapiens
  ENST00000475630
aggaaacaggcagagagaccgctgaagtgaaccggggcttgccaggggtgggcggcagccgaggcggccagaaaagaactttgaaggaagaaaggaaattgtgctaagacgtccttctatggccgcttcaggcacttcttggatatcatcgaccctcgcacactctttgtcactgaggctggagtgcagtggcgtgatctcagctcactgcaacctctacctcccaggttcaagcgattttcctgcctcagcctcctgagtagctgggattacagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgcca

SEQ ID NO: 18862 - DNA, 1690 bp, Homo sapiens
  ENST00000472259
tccgggttgtgcagctgcccgcccgggacgcaaagttctagtctggccctggatgggaagttggcgtggccgggatgccttctaactttttcccccggtggggactgacgttcctttcgagctgctggcggtgccgccgggcagcgtcgcgccccgcggtcactccccagccctggcccccaagccgggctcggcgcgcgcagcaggttgagggggcgagtgccgaggcgagcggcggtccggcgtcccccgtccctgctctccatctcgggctgaggattcgctgacgcagcaagccggccgatgccctgaggggacgcagccagggcgtgcgggggaaacgctgtgtcatcccctggggccgtcgtccctccgaggggctgccgcctgggaacccccccccagcctcttcctcgctgtgttctccgcggagggtctcccgcgcccgggcccccgcgccgccggggactggctctgggcacacccgctcaggctcttcggggcacggcgacaggggtcctttccctccgggacctcctctggggcgtcgccgactcggccctagactgcggaggcgggggtggaacgcggagcccgggcgcctggttgggcccggagaccggagccggggaggggccgctcccgcgccgcagaccctcgggctcccgcgcctcccgcaccaatgagacggaatttattaggaaacaggcagagagaccgctgaagtgaaccggggcttgccaggggtgggcggcagccgaggcggccagaaaagaactttgaaggaagaaaggaaattgtgctaagacgtccttctatggccgcttcaggcacttcttggatatcatcgaccctcgcacactctttgtcactgaggctcacagctggaggaaaatttgcctcaggatgaatcacacctttgggtctcatccatacctaatttagaggattctggatgagactctgacttcagacttttgagttgctgctggaatgactgacttttggggctactgagatggaatgaatatttgtgagaaggacataaattttggggggccagggtgagatgctatggctgaaatgtgtcccatacaaaattcaggtgttgaaacttaatggcaaatgtgatagtattaagaggtgggatctttaagaggcaattaggccatgagggtccctccctcatgaatggaattaaggcccttgtaaaagaggcctggccgggtatggtggctcacggctgtaatcccagcactttgggaggctaaggctcaagaatcacttgagcccaggagtttgagaccagcctgggcaacatggccagaccccaactcttaaaaaaatttttcaaaaattagctgggtgtcgtggcatgcacctatagtcccagctactcgaatcggttgagcctgggaggtcgaggttgcagtgaactgtgatcacgccactgcactccagtctgggtgacagagcaagacactatctcaaaaaataaaagaggtttcacacagggtttggccctcttgccgttctgttctgttgagtacacagccttccttccctcagaaagatgccctcaccagataccaaatgctggttcttgatcttggacttccagcttccagaactgtgagaaataaatttctgttctttataaattatctagtctgtggcattctgttatagc

SEQ ID NO: 18863 - DNA, 351 bp, Homo sapiens
  ENST00000484123
ccgctagcgcctcgagcgatgcacctcctttccaactgggcaaaccccgcttccagcagacgtccttctatggccgcttcaggcacttcttggatatcatcgaccctcgcacactctttgtcactgaggaagaaggctgtctttgttctaagaatgccttgaacaaagcttcagaggaggaggttgccctgcttgacagaggagaagaatggtgcattttgatcctaaatggagaaaggagagggaaggaagaggaggaaaaaaacagcgggaaggagagcatgatactgagatgagctgaaagaccaataaagaaatgccacaatgaggtgtggctgggggctcttttga

SEQ ID NO: 18864 - DNA, 671 bp, Homo sapiens
  ENST00000488839
ggagctgccccttgtcctgcacttcagcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgaggtaagtcatggctgtcacctcagtggcccttgggcctttgtaccttgtcatttcagaatatgtgggtcattaagggagggtgaggatgggggagtgaagagaataggggaggtgagaggtgagaggaaggtaacaaattctctctacctgtagctgtctgtttatgtatctgtgtgtctgtctgtatctgagttgatacattgtgctgtatgctttttacattatatcatttggatctcacaacaaccctttaagatagatattattgttattctttaaaactttcaagaaattattatcaagtacataagttatttgctcattagaaaagttcaaacagtacaaatatgtttaagtagaaaaaagtatcctttaatcgtcctccctacttagttccctcctcttataggtaacagctgttaatggcttttaacatcaggttattaaggta

SEQ ID NO: 18865 - DNA, 734 bp, Homo sapiens
  ENST00000513942
tctctgagaagacagagagatggccaggtgatgctgggacaaatactgccttgcctgaggggacgctgactctggaatttggtggctctccagggatgagcgggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtg

SEQ ID NO: 18866 - DNA, 542 bp, Homo sapiens
  ENST00000514934
ctctcctccctgccccctgtctctgtcactcaccgggcgggccaggccgggcagccatggctgagacactcttctggactcctctcctcgtgggcaagttggggccttgttcagcggggaggcccaggatgagggggcaggatttaggggtgttctcctggcagggctgggggacaccgaggcccagcagaccacgctacacccacttgtgggccgtgtctttgtgcacaccttggaccatgagacgtttctgagccttcctgagcatgtcggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaa

SEQ ID NO: 18867 - DNA, 1090 bp, Homo sapiens
  ENST00000513821
tctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctgg

SEQ ID NO: 18868 - DNA, 1057 bp, Homo sapiens
  ENST00000344627
ctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 18869 - DNA, 1432 bp, Homo sapiens
  ENST00000262018
ctctgtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcgctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcattgaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtcctc

SEQ ID NO: 18870 - DNA, 1349 bp, Homo sapiens
  ENST00000502555
gtcactcaccgggcgggccaggccgggcagccatggctgagacactcttctggactcctctcctcgtggttctcctggcagggctgggggacaccgaggcccagcagaccacgctacacccacttgtgggccgtgtctttgtgcacaccttggaccatgagacgtttctgagccttcctgagcatgtcggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaaggggtatacattaaggtgggttctgcctcacctttttctacttgcctgaagatggtggcatcccccgatagccacgcccgctgtgcccagggccagcctccacttctgtcttgctacgacaccttggcaccccacttccgcgttgactggtgcaatgtgaccctggtgaggagggaccctgggtccgggggtggggtggggcatggcccccatcccagtcccccttccctcccatgctgcttcctatctccgtctctctgattgctccagtcaccatttctttccctgatgctctcagtattgcccacaggcttagtctgaggatacacacacacacacacacacacacacacacacccctgaagttctacctttcccccacaagagggcaacagagtccgcaatccgcatgtggggtctccaactcccgcgccccagatctgcccaggtcaacagctatatcacagtccagttcccaaaccctttccctaccaagggcctctgcgtgacagctctgtctgcttttctgtaaggtgccacctagcaaacccacttacaacaaggatctgatagctcttcacactataaaccaaagatgctcacaacagctctttggatactgagctgaggttcacaggatcccacggctggtgtacactgttcctgtgaattgaccaacagagcagggactcattcagggtccacagccagcgactggtaattgacaacattcttgagcacttgctatgtgcttggcactgtcccatcaacatattttatgctcaccaccactccaggagacaggtgctactattatccttctgacattacaggtgatgaaacagaggcacataatcatcctagctaagcacttgtctgagtctggattc

SEQ ID NO: 18871 - DNA, 668 bp, Homo sapiens
  ENST00000511303
ctgagacactcttctggactcctctcctcgtgggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 18872 - DNA, 577 bp, Homo sapiens
  ENST00000512526
gctgtcccacccgctgtccacatcacctaccacgcccacctccagggacacccagacctgccccggtggctccgctacacccagcgcagcccccaccaccctggcttcctctacggctctgccaccccagaagatcgtgggctccaggtcacagcctacaatcgggacagctttgataccactcggcagaggctggtgctggagattggggacccagaaggccccctgctgccataccaagccgagttcctggtgcgcagccacgatgcggaggaggtgctgccctcaacacctgccagccgcttcctctcagccttggggggactctgggagcccggagagcttcagctgctcaacgtcacctctgccttggaccgtgggggccgtgtcccccttcccattgagggccgaaaagaagggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgc

SEQ ID NO: 18873 - DNA, 696 bp, Homo sapiens
  ENST00000504073
cttggaccgtgggggccgtgtcccccttcccattgagggccgaaaagaaggggtatacattaaggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggctgaagagagacctggctacctccgacatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctgg

SEQ ID NO: 18874 - DNA, 410 bp, Homo sapiens
  ENST00000508382
cttgtgggccagacagcgggcctgcacgcatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctca

SEQ ID NO: 18875 - DNA, 494 bp, Homo sapiens
  ENST00000505964
cgcagggtggctcagaggcagttccaggctgtactccagggcagctgactcccagagctgatgactccccacctgtgcctccagcatccagatggtccaccactgcaccatccacgggaacacagaggagctgcggcagatggcggccagccgcgaggtgccccggccactctccaccctgcccatgttcaatgtgcacacaggtgagcggctgcctccccgcgtggacagcgcccaggtgcccctcattctggaccagcactgacagcctagccagtggttccaggtccagccctgacttcatcctcccttctctgtccacaccacgagtggcacatcccacctgctgattccagctcctggccctcctggaacccaggctctaaacaagcagggagagggggtggggtggggtgagagtgtgtggagtaaggacattcagaataaatatctgctgctctgctcaccaattgctgctggcagcctctcccgtc

SEQ ID NO: 18876 - DNA, 1412 bp, Homo sapiens
  ENST00000517913
gtgatatctattgaagctgggagggtcacagtatcagtgagtggtcccccaatttcttcttgagcatcgatgaattagcagtggtgtaatattgtggatctgacttcatgtgtcactaagaacaggagatccaagactgctcttctggggatgagacttggaagaaacctccatcctcagggatttgaagaaggttatactggaacctgtgtgaaggctgagacaaccgtcccttttgtggtggcctgaggggattttcttaatcccaatgttgccctgaaatttatgtccaggattcaaaaagtttaggactgctaagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagaggtgagggatgagaaggacagaagttcaaagagctacagcttcaacaggccaacccttcccataactggttgacctcggagttggatcctacagtgtatcaacaaaaggagccaagcaggttttatttctgaaacaattaattgagcagcatgattataagccaaacccacaatccatcaaagtgatgatttcttatttgtaaaatgcagagataatggcatgtattccaagtacagaattatatgaccatgaaaatgaatgctattttcaaattctctcttgtcaccttaaaataagattttgttagccaacataattaagctgtatatattatacacatctggctcaaga

SEQ ID NO: 18877 - DNA, 9755 bp, Homo sapiens
  ENST00000435422
gagcagaagaaagagaggacttatctccagcatctagcactacagagcagaggctgtgtggagaatggctgaaaaatcagaattggttgtagaagcagttttctttctggttgtgagtatgagcccggcagacaccatgagcgctgttgcaggggagtcggcctgtgcttgacacatgtgtttcccattgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaatgaggtttcagtacaaaaggaaccatgggtgaccctgcgatatccactgtcattttccatcccatccccaccacctgagtgacagaaatctaaacacacatccgtcccaacattccccagaccattcagaatcacacagcgtattaaacactgacagaatcttcatctagatattcgagtagcagcatatcttctcttttagtgtcattacgagggagtgatggcgggaatctcagtcgcactcaagctctgagacctttgtatcaaaaataggcatttgatttcctgttttagctttagtaaggctggctaacttccccctcttcaagctaggaactggcaatgctgtagaagtcagccgtaggaattcaaaatggctggcctaccttggctaccagacatattggggtttttgtagttgaatgaatgaggaggatgaatttcagcaaattttgaactgctcacccaacttctgctatcttgctccctccaaactcacagattctcctacagtcaaattaggagctgtaaatcagcacaaaataagataacagctgttcctcagtgagctggaagctacttaatggcctgatgggcaatgaacaaacgggtgatatgtctctgtttaagggaaaaatggcttaaaagctgttctgttctcacttctgactttaaccaaaagatttcaacccacaatgatcaggtcaatcaaaatccctaagagcagaactcctaccccaaaagaagcctggaagtctaattaagagtagcataaggaacctaattatgtttaccatgtttcttgggattggtgggaaatgtcaaaacatgccctttatttttaaaggcattcacaaactctctgactttgttcttcttatatattttttcagtgccgggatattcatattcctaaagccactattgtgttttctctaagaagcactacatgccaccagaattgtgcactgaaagataatacaaactgagtgtctttatgagaatcactgtgtcccctgaggcccagcagtacctgcttccctgtatgtggaagcagcacctcattcccgccatcagctacctctcatcaccccaccttcatcatcatgctccagggtcaccctggccagctcttgtgctgggacaggggattacaccatctctgttcaaagagggggaaatgtgcctatgccttaagtcaatgcactcagcaaggagaagcacatcttatttatcttgttacctatagtttactttgggtgattggaggggaatgacttagttatgactggacatcttaaaagctgatagacaagccaaatggctggcagatgatgtggatttcaaagagcccagaatgaactcatcactggcttagacagtcctggatgccatttggaaagtagtggccctgcaagcctaaatgaagtagtatttgtaggcctgggtggcatttggatttttcttttccctcaacaaggttttactttttcttactttacaagcaagggaagttttgtgataggagagaaataaaagatttgatattttttgagatgacactcaagcatcaggctgagatttgcacacatgggatgtaaaagcaagctgtgtgttgcttagtcacttacttagaagtagatggtgggggacagcggcgtgggtcctagcctggccagtgatgctgctggcgtccagaccccagactcactccaagcactcttgttcaatatctcatgcagaagagttgggctggtcactcttaggggtgagaccccgtgattggttggtttgtagcactaaggtctaaaaaggaaaaccataaaagacatcagattacgctggatcagtataattaatattccatagggccatgttgccagaatctgtatgtatcaatacagggtttttccaagccaggaaacgccctccttggctactaggagcacctatcccatatcattcagataaacaatgatagctacaaagtcatttgtggctagataggttaagacaggtgattttttaaagtagactgtctttgcattttgccatctgaagttcattaatctttagatgacaaaaaagcaaaaagttcccagaacgtttttgcttagattttgttctaatcaccacgtgaaggaatgagattagcaccacaagtttcatgccaataaaagagactggtgtgatcccacatgcaaaatttaatcctaagggtagtgagatcacaaacagaataaaaataagagcaatcaaccatataaatcaagtacctattgggaacagacataacattcaatttttcatttatgctaagtgaccacagtatacaaagtaataagcaggaaatttgatatgggttaaattatgcattttgttcagattttggaaattggtatgcattataagtttctcaatgtacatctttttatcccaacaccctcaaactagaatatttgtcagtggtcaagagaaaaaattttacctgaattcttgggggccggcggggagcttttacattaaaaatctactaacgcctactttttaaaaaatgagattctttctaatctttatatatgacattttctagacaatcgcacctttgggtatattaaacagctggtatcataacaaagaatccaaatgaaccttcaatatactagaagttctagtaggttaatattgttcagaagatttttacaaattaaaaactgatttccaaatatgttcaacatttacttctatttgatatctgctcaagaagtcatagaagtcttgggaaactattcgagtatcacagaggttttcaaaagcccttatggtgacatctacctaggtaaaagcctgacatgtggctttataattgttatgttacccaagggataaacttgaactggctttgaacatcctttaggtcattttctctttggataattttcatcgcatatccagcaactatagaccaaagtttgcttaaggtttgaccctagagcagaggtgggcaaactatgacctggaaaccaaatctgacttaccaccttttcctgtagttaaagttttattgtcacatagccacatacattcatttacatgttttctgattttacactacagcagcaggatggagtagttgtgtcagagactatgtatcccacaaagcatagattacttactatttagtcctttacaggcaaagtttcctcacccctgacctagaggtttttgtggtatgcattggatatagcaggaaagaaagcacatttccaaacagcagggagtaagcttacatttctgtgtaggtttgggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcagcatcattgtgtaatgagagtgaagtaggggaccctgtggttcaaccttagaatctgtttcctgtaggctctttctgctgtctatattcattaaagttttccacttcaccctcccatagtctagagggatgcccattccatggtcctccagagaatagttttgacttaacatgtctgtttagcccacatcacgtcagttatcaacaccgccactgtgcttactgttcctacagccacaccaggcttgaagagttagtgagaccaacaaataattggaagtattggaaaaagcaaaatacatggggacaaaaaaaatacagtgaaattctttttatcaaactgatgctgtgagaaaccagatgaatgccagtttggctttatttctaagaatctgggtcttcattctctggtgtagaaggaatgcaaaaaactataacaacaacaacaaaaacatattttgaaaagacatattctgacatctctgcttgtgtgtggtaaggcaggttcctatcagacatttatccctttggtcaagatcccttttgctcatccagggtttcatactcaatatcgcttaaaaaaaaaaaagtatcagctagggatgactctggaagtatgagtatcatggtggggaggaaggaattttttttaaatgtaaatgacccccatttaccagaccctaatcaaagtcacttaagggaatccctcagccttttatttggaaacagttgaaataaactggcagcagctagatcagagtatcttgctttattttataaaggccaaaggtagtatgaagtttggaccaaaaaggtaaatagatccattccagcacctgatactgatttttcaaggctctatgaaaggtcaaaaatttcattaaacaagaccagttctccctcttccccctgtcccaagaaatcttaggcatgaaaaggataaggaaacagctcctggaatgatacatttgcatagtgccctagtagcaggttgggaaaaagttataatataagaaacaaccttcgaaaacaggccttttatctcaaagataaaatgtctttcttgtggtctttcatcactatctccgtggtggaaggttcccctagttccaacatatttccattaaaatagtcaaagccacggcattgggatgtcagatgcctctctttctttgtggtaatcggaatttaaaattatacagttgcctctgaatttctcatgcacaaagccaaaccactgataagagataaagcagtctgaagcctgctgcttcagccagcacagcacaccacacacgctcgcactttcaaaagcaatgtgatttctatggttcttaaaagctttcttcataagggagtccctgaaatttctcaaggcaggtttgaatggcaaagggaaaataattacttgtgggaggtcctccttttgagtattgttagagcatacatgtaaaagaaaataacctttttggggcaactcatgctcacacatgctgttttctttggttctccccctaccttccttttgtagatattgacagaataggaggaaatgagcatccttatttgagaaagagcaagaatgtcatgagcccttgatgcaatagtaagtgtgatgtcatcatacagtgttaatgatgctatcaaatccatcaataaacagtctcaaaccttccaacaacagtgctcactgctgctcctcaacttcagcccagcaagcagtaatatcatcacccattttgagatatgcaggtggaatagaacaaagaaacagccactgtaatcgagaagcatgtttactgtctaaatccacctgttgcagtaggaagccagagtggggttccaaatgcctcattaagtatgtggacagcctcactagtaagtgagtgaatttggcttcatcactgaacattagctaaggtcagcttaataacacaaatatgaggccgacttctttgcgagaagagaaaagaaaacatctgcttgatttaaaatccaccccacatgcctagagttgtctaatagtccctcactttccaatggcttcacatcctacttctacatttggggttttttggtgaaatcagagatagctcaggatttcataaaacgagaaactccaaactggtctattaggttccatgggaacacttgtagccaaaggattgtctgagggcaggaagacgacacttgtcaacaaggaagacagtgtttctttagttcccatattcatctaattcatggggttctaacattttggggggccatagattcttttgacaatctgagccaatctatgaaacttctccccaaaaagaaccaccccacaaaatcttgcaaaacgtaagagattttcctggatctgaagctacccgaagacatgggaagagttgtattctattattcaattttaagaatatttattaatattcactgagctattgctagccactgtgctaaacattttacatacattctcctatttcatcctcaaaacaatcctttgagttgggttttaatatagttccaatattcggatgtgaaaactgaggcttatagtggctaagaaacttgcccaaagccactacctagaaaatggcagagctggaatgtaggtttaactcctgaccactatgctataaagtcaccacatgtcaaactaattttcaagttgttgggacatgtcccctactaggttttaaactagatcttccttggtagatgaagctatagaacttctattttccctgctttctgtagtctctcacagtgacagcatctatactaaagtatagatacctaaggggaaaatatagaaagcctgcctgaataatagaatctagaacaacaacaaaaatattaattttttctgtgtatgcttaggtcaagcttaaaaaaaaaaaaaaaagaccggaaaatacctgggttgttagcctcacatttaggaaaaaattgtaatactcagttatctgtgtgtgtggctaaacaagtcagcatttctgcacacatacatctctttcctttatacttcccttcaaaagacaaatatcttacttttgatctttgacactatttggtcagtattcttctttacctttacttgtggcaaaactcaaggaagcgatcaaatagagggaagctcatttctatcattgtctctgtttccctataagaaagaactaccagggactcactgactgcattaggcatacaatgtcagagctgagctgaccactctggtcctgtaatgtctttggcctcacaccttggcagccatcattaatgggccatacccttccccaggtgcagaattctcctccccagagcactcaggccgttactaccaatttatctgagttggaaataagactcatttgccagttcttatttttaaagtggcaccctttaactttgaacctgtgtattttacactggcatcctagattcagcaatgaggtttggtggtgtttcaactaggaagggagaaaatgagtgcatctgaagttccttacagcttggtttctttggaatgctttcatcttctaagcaaagggatcagggtttgatctgtaagagttaaaaagacaaagtcattttgaagaattaactcagccagggatcatgcaaaaagattagaaaccataatgcccttgttaaagccctgctgtcaacctgccttcacccagagcttagagggccacagcagcaaagaggttggggtccatccctctctgatgtgctttttccacaacacatatctggtcctctggcaggattgtggatagagctcctcaccatacccaaaagactcagccccagtgccagtgctttcctggttcaacaacccaccacaaaaccttagtaaaaggatgagccaaaaatgaaaaagactcgactctacagtaagtcagtcagggatttcctttttaatggtttaagacatccaaatggcaagccaggaatagataccattaaagggtctcataggactaaccttaccagagccagaaatctagctctctggaagagatgcaagattctagaaaagtaaagggaagtgtcggcacatctaaatttagtgaacacaaaattaatttttatctagtctgtgacggagggaataaagtttttcatgtatcaaccacctcccccagtcaggtttctccctttttgagattatgaagaagctgagacatacttcttaaggaggtcgtgttttagaaggaaaaggcagaggctatccatcattatgctggctagatgcgcttctgaagaagccggattctgatgttcttaaccaaaatggtgaggtcatggaagtcccatttgcttggagattttgaaaaaaaaaaaaaaaaaaaacccattcccataaagtaattgagttcagcctttggattatttttggtttggtttttctctggttttgggtgtgatgtaagaagagctttttagttttgttttgaataacatcaatccttgcacactctatgcaaaaattttgtaagcatttcaataatgctatgaattacaaggaactattttaactttattacactttctgtataaaaaatttgtatttaatattatttcgaccacagtcttgtaaaatatattaataaaaataatgattggtaagaaggaaa

SEQ ID NO: 18878 - DNA, 1606 bp, Homo sapiens
  ENST00000337851
agagaggacttatctccagcatctagcactacagagcagaggctgtgtggagaatggctgaaaaatcagaattggttgtagaagcagttttctttctggttgtgagtatgagcccggcagacaccatgagcgctgttgcaggggagtcggcctgtgcttgacacatgtgtttcccattgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgatggaatgggaaacctgaggatcacagaaaaaggtctaaagctagaaggagactctgaattcttacaacctctctacgccaaagaaatccagtcccgaccaggtaatgccctgtacttcaagtctgccagaaatgttacagtgaacattctcaatgaccagactaaagtgctaactcagcttataacaggtccaaaagccgtagaagcttatggtaaaaaatttgaggtaaaaactgtttctggaaaattgctcttctctgcagacaataatgaagtggtagtaggagctgaaagattacgagttttaggagcggagggcacagtgttccctaaatctatagaaacacctaatgtcagggcagaccccttcaaagaactaaggttggagtccccaacccggtctctagtgatggaggccccaaaaggagtggaaatcaatgcagaagctggcaatatggaagccacctgcaggacagagctgagactggaatccaaagatggagagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaa

SEQ ID NO: 18879 - DNA, 739 bp, Homo sapiens
  ENST00000524347
agcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagagacattactgccgggagtgttgagtgaagggaccaggtggagatgatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattagcatccatctgcttctgagatttaactggctattcagatgttgtggaatgagctgagaggagccagaaccaggagccaggtgactcagattccagtacccactttgctgctggatggaatgggaaacctgaggatcacagaaaaaggtctaaagctagaaggagactctgaattcttacaacctctctacgccaaagaaatccagtcccgaccaggta

SEQ ID NO: 18880 - DNA, 2225 bp, Homo sapiens
  ENST00000373100
agggctgggaggttgaacttgagccggtttgggagccaggagcgagtgggtgacaggtcattcctgactgggaaggttgcttgacaagtcaggattgtgcctccagtcagaaggaccatgaagagagagaagagggcagagccgtgcatggggctgctccccaggacctgagcaggaacctggagttttcagggtgagatggtgttccccagggaacagaagtctccagtcccatcttaagctctgccggatcccgcgtgacatcagctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 18881 - DNA, 1736 bp, Homo sapiens
  ENST00000373077
attcctgactgggaaggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtggatacactcgggccaggcaccagaaaagcttcttttcgttgggattttaaaaagacagtgaagataatgtcgaacttataccctggagagagaaccatacatggaatactaggcagagatgaatggactttagaatgagacactccggagctggattcctggttttgtcacctaccatttgtgaggtcttcaacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttag

SEQ ID NO: 18882 - DNA, 1906 bp, Homo sapiens
  ENST00000373092
ggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 18883 - DNA, 2395 bp, Homo sapiens
  ENST00000496343
ggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttgtagcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaataataaataaataaatacgaaaagtggtttgtttttttacaaatgtgtggttcatactcctgggtggccttattagcttttttggttgggagacaagggaaggaactttcttggatcagtgtgtgctggtgattttattgccttttcctcttaattcaatcccactctttcccttcctcaagtcttgttcacccagcctcctgccccaggaatcacggggaagaagtctgggagaccacagaaaaaacaccaatgacactgagctattagagatcaaaactgggtcaggaagagttcatgttaagctttcacatgtgctaagaacgctgaaagatacacactgatttccatcttaatagtgccagataattgacaaatttgggacaagatgagggagaggtcaaaatccccctaacttcccaaagcaaaaaaacaggagtataatgatcagaaacgtaatagtagtgtcagaagcacacaatcagctgtggacggtgaaacatataatggttctatctgttctgagattgtaaaagcacaattattttcatcaggataaaaaataaaaatgaaaaactatgctgttgaatggaa

SEQ ID NO: 18884 - DNA, 554 bp, Homo sapiens
  ENST00000617268
acatatgctgatgtaaatgtacaaatgtggtcacactgacacatacatgcaatcatctacgcagactcatagaaaccgacacaaatacctgaaatacacagccacagacagacacacacggaagcactctatgcacaaaacactcacacagtacacaccatgctgcacataccctgacccaaacagtctaacaagccctgagggtctccagggctgccctggggctattgcccacccctcccaccgtccccgctagggtgagatggtgttccccagggaacagaagtctccagtcccatcttaagctctgccggatcccgcgtgacatcagctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcagagctgcctgatcattgctacagaatgaactctagcccagctgggaccccaagt

SEQ ID NO: 18885 - DNA, 612 bp, Homo sapiens
  ENST00000617358
acttaggcccttgttgggagaacagagagaggctctcttgtccactgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagaggtgggtgggcccacagggaggcttccctgggctggctctcggctgggagctgtccatcccacatgcccactgcatgccaagttctggaatgatctcacttcatcttacaatagacccattttgtagc

SEQ ID NO: 18886 - DNA, 676 bp, Homo sapiens
  ENST00000412111
actgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgag

SEQ ID NO: 18887 - DNA, 2498 bp, Homo sapiens
  ENST00000341458
agggtggaagcaaggaagacactattcctggccacatagatcagctggtcacaccttctgttgtttggccccgaatagatattggccagtcttgggtctctctgtggccccagcccaaggcttccagggcagctgcctttcctgaggcattgggcagaattccttgtggcaaggagatcgtagcacagagcccagctgggactgcgcacagtaattcagggttgccattgttcctctatgggagtccggagagcccagcctgtgcttcacaaggctatgtggccctaggaaggtccttttttaggccacaggccttccatctgtgaaatgggggatgggttcagactttatgccctgaaaagatccttccagccctggccatcttggacttctggagctaccctggctcacaggggtcttgttgccctgggtgtccccagttcttgaaaagaatcagcctgggaggggccacaccctgaccatccccctttatcccttctgagatgtttgttaggaagtctgggtccaggggatatcatttcttgttccatccatgcaggggttgcttacctcgggtaggaaaccctcaggcggtggcaggtgcacaggtaggggaggatggagagggcagtggtgcctgaagccctggatgggcggagctgaccccccaacaccaactctctcatgcctgctcctccctgtccccccagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 18888 - DNA, 1182 bp, Homo sapiens
  ENST00000426287
atgcaggggttgcttacctcgggtaggaaaccctcaggcggtggcaggtgcacagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctag

SEQ ID NO: 18889 - DNA, 428 bp, Homo sapiens
  ENST00000485914
acacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacaggtgaggcctgcctgtggctcagagccaggaccaagcccttcttgctccaacagctaggggttgtgtggacactaaatcctgatgaaatcctggtggacttggtcctttgttttgggtggggttggagtctcctcctccgaggtccaagtgcccagcctttctgggctctccttctgcatctctggcaacctccatgaatagttctcctgccaggaccaccccccgcccaggtctccaactctcctcactaaatggctgagacacctc

SEQ ID NO: 18890 - DNA, 1915 bp, Homo sapiens
  ENST00000423407
agctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttg

SEQ ID NO: 18891 - DNA, 582 bp, Homo sapiens
  ENST00000506462
agattgatctctgttgccgctcagggaggtcagctccaggccctcagcctttcggccgggagccaaactgccctgcctgccaagcccctccttctctgcaccttaaacagccgcgaggggagagtcggctgggattttcttcttaagaagtcgcgcaggtttttcgagctccactctgcgccaggagagccacggcagcaggaacgggcactgctgccaccgggccgacggagctgcatcctgtggccctataacactcttctccaaaaggacctgccagagactgggagtgttgactgctgcaaggaccaaggtgggaattgctgtgctaccatctggaaacagtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactag

SEQ ID NO: 18892 - DNA, 6149 bp, Homo sapiens
  ENST00000394684
agattgatctctgttgccgctcagggaggtcagctccaggccctcagcctttcggccgggagccaaactgccctgcctgccaagcccctccttctctgcaccttaaacagccgcgaggggagagtcggctgggattttcttcttaagaagtcgcgcaggtttttcgagctccactctgcgccaggagagccacggcagcaggaacgggcactgctgccaccgggccgacggagctgcatcctgtggccctataacactcttctccaaaaggacctgccagagactgggagtgttgactgctgcaaggaccaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctacagccactgtgtaaatagaactgcctaatgttgagagtggtttttagcattaggtttagcaagggggagatccgtgggttgtgcgtcagctttgggtgaattttgtttctaccctgtcacggggaaagttcgggttgagtccaggagtgcacactgctgctgccacccaatgcgctacatatcacttttttttgttttgttttgttttgtttttaaaagatcattttatcttaaaaaggaaagctgatccaagtaaacacgaaagtatttgacacaccccacagattttacatgtgtgtaaatgtttcactttaaaatctctatgacagatacacaggaaacatgagatggtttctgctaatgagtggcccttgagtacacacttagatgctgtctgccctgtaaatttggatctggtgccccagggcagtcaactcttctagcacaggctgaaaacacgtgtgtgtcaactgaggttcacaccacttggggaatgagcctgttttctttccaggtcaggccctggtgtgagatcaattttagggctcctaattggagcacagaaatgtatttggtcaaatttcattgaaggtgatttcttcctttttctgttgtactttatggaaaaaccaagatggaacctgaaagttaatgtatccttgcttttagcaagagactcagtttcttataactagtcctaaggacatatgccgcaattgagtaattttacttttaccctatgaaaataacatggtgctgcactataatatactctcggaatcagtgtgttagttacagctatacagtgaagggggataactgtttctaaatttctttaaggtgatgccaaaaaatggattaaaaaatctgatcagatttaatgttaccagatttagtgcattatttaatgctattggatcttttggataattcttggcttaatttcttagctacttgaaggttaatttgcaagacttttaaaaccttagaaaagttttaaggttgcaaagttatcaacactggggcagagggtggagaggccaatgcgggtagaaggaggcagttatgtttatattgaaggtgaaatttttctttcatttagaatggaaaacatccccaaatgtatcattataaactagtcagccttgactacacaaaattgacctttaagttgcttgagaaaaacacaatgcaaatcgttcagaagggtcaacatcctttggtgctaaaatcttgtgtatgttttcagaatggctttttctgtatgttatagaataatcactaaaggaaaggtagttgaatttaaagtcatgaagcaagactctttaattcagttattttaaacaagaattaaaaccccaaacatccttggcaggctttgaagcacacagaattttctagtatttcttattaaatacaccaataataaacatatacttagtttacctgatgagtttagacataattctatataatgttcgcttatattcatttattaactagcaacacttgtgcaagaacaaggtattctgcttgaaaacactgatttttaagttcctgttgcccgattgtaaagaaaatcatctgacacagaagcctggattttgctctcctaacactggtgttttccttgagcctctaattcaaataaaacaaactgatacaccttacagccttattcatctgtgtctggataactcacttttcatctattgaataagaaaaagtgtttaaacttaataaaataaaaaattgtgcaccaattactacagatccttgaaacagtaagccttggattttagtcaagtaatccagtttttttttaatttaaaaaaaaccatcaccttttaaagaactttaaaaacacctgtgatgccaatgtggacattgccgctgccatgtctttacacgcatgtgtcgtatagctctgtcatcgagttgaggaagtccatggtttgcaaataagggtgggggaatcaaaatttcaagatggaaaaataaaacaaatagtaaaacccatttacatgtaggaaagaaaagttgagcttcaacccaatgtgccactttgatataaaacaagtatgatatatatataaactgaagatataaaacaagtatgatcttgcctttgaaatcataaatgtttggggtacctgttctttgccagttaagatacatatcttattatctttgtttttttcaagtctatgctcctgtttgaagcttttcctgtaatttaggttgtctgtgaaatacctataacatataattcctatagagtatgccacattttttttctaactcatttcaaatgaaattctctcagattctagtttttgagcttgtccactagatctgaaaataaagcatcctttcctgagtccacttgaactaattgtgaatttgttacttaatttactggcatcttgggaaacaagttttgctgtggcaggaaggctgttttgagagtgagcgttgagtctactctggtttgtggatgacattgcattagggttatttcctgtattaccagtgcccccttgtggcaatatactttatgacttggaatgcaaacaccacttttaaaagcctgttttcaagtttttgaaaggcatttgttttctgttgtttgccaataatctgaaagtatcatgtgaaaggaattattttaaaagcattttaaacctttcccaaaggtaaaatgtgctcagattataggcacttgtaattctaaccttgtatccatttgatcaaagaaaatttgtagaacatttttacctctcatgatcacaatcattagtgtctccctttataacgacctatgttttgtttactttgaaacaccaaatttgttgtcttggttttttttacatgacagaactcatgcagtttcttttttagttgaaagttcacatcttgccccttgaatagtttgaacatttctttcttaattcttttttgtttttgttttgcactgtaaaactgatgaaaactttaagccaatcttaatgcactagcctctgtagtgtaaggaagtgtgagaaggagtttcttaatgagtttacacgtttaaatcaagcatattataagttatatgccatgtgttgaaggcttttctatttatatatataaagatttttagtatttgtttttagtgtccttgtgttgcaataatttaactcctttgactcagttgctgaaaatatttcttctattaagaagtgctcttgacttcaacacccaaacactgaaaatcatgtcaatgttacccaaagataagtttttatacagatacacaccttataagttctgatttattttcttactcattatgctgtgttctaaataaatcatgaatgagaagagtgctttattgtgaaattatttaaaactgtcctttaaaagaaaaagaggaaacgatgaacaaaaactaatctaattgccaagttagaattcattatttaatttacctcctatgcaatgattaatgctgcaaaatgtatggttatgttaccgtatattcacaaaagaaatattattacaaggtttcagaggtagccaattgcattcttttggaaatttactgtactgtttcaatgtgttaagtgccttgttgtaaagtaaaattttaagtctagattcattattttcctgacatatatttttcattatgatatctactgtatgctattgtgatagttttatgaaatgcttacattttaatcaaatatgtaaatttcagaagctcttttttcctacccaccagtaccttaatcattggtttatcacattggattcaaattcaggttccttttttgataaagaggaaatttgttttccatgcttgtgattttgtgtttgtaaacatttcaggaggaatttaggagtgtaactatagtttatacttctataatgttgtcttacatttacatttttaagtgcctaattgttaaaactgatttatgtttctcttctaaagaggatatgtgtacttggtttctaatctctttggttttgctttttaaaaaatgcaagagcctatactttgtatttacctaataaaccacagtgacatcaacagtcttttcaaaattaa

SEQ ID NO: 18893 - DNA, 498 bp, Homo sapiens
  ENST00000515332
gcgggccgcgcgcggcgggcggggagagcgggcgcggggccgcggtcaacactgagcgccgcgccgtgggccgagtggggcggggagacccagccctcggcgcgcacggagcctggccggtgctgcagcgccgccgagtgcggcctcgggggcggcggccgcgggagggacccggagagctgcttcccctagtcaggccgcggcgtgggagggcgagaccccgagcaaactttctagcggcttcggcccgagggtggtgacgcccggggctggtcgcggcggctgcggcagcgggctccatcccctggcaaatccccttcccgggagcaagtgccttcagctgggagtgtctggagccctggccaccagcggagctgcatcctgtggccctataacactcttctccaaaaggacctgccagagactgggagtgttgactgctgcaaggaccaaggtgggatagtaacatctttttgagggaagaattggcttcctttc

SEQ ID NO: 18894 - DNA, 567 bp, Homo sapiens
  ENST00000503862
gcaagtgccttcagctgggagtgtctggagccctggccaccagcggagctgcatcctgtggccctataacactcttctccaaaaggacctgccagagactgggagtgttgactgctgcaaggaccaaggtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaag

SEQ ID NO: 18895 - DNA, 1887 bp, Homo sapiens
  ENST00000359079
agctaccttataaagaccatctgtacatccactgtgaaatggagtttcaaaatcacaagcttctttcccacatgaacataagactaggagcacatatggaagagtaaagttgaagggaatttggatgatgatttggcaagatgctgtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctaca

SEQ ID NO: 18896 - DNA, 570 bp, Homo sapiens
  ENST00000506993
atctgtacatccactgtgaaatggagtttcaaaatcacaagcttctttcccacatgaacataagactaggagcacatatggaagagtaaagttgaagggaatttggatgatgatttggcaagatgctgtaagtggattaggcaaggctgctaaagagagacaggaaatggctgtgttagtgcttcggacctccgttagaagtagcagttcatggtgttgaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaa

SEQ ID NO: 18897 - DNA, 2127 bp, Homo sapiens
  ENST00000394686
aaatggagtttcaaaatcacaagcttctttcccacatgaacataagactaggagcacatatggaagagtaaagttgaagggaatttggatgatgatttggcaagatgctgtaagtggattaggcaaggctgctaaagagagacaggaaatggctgtgttagtgcttcggacctccgttagaagtagcagttcatggtgttgaaggtttgttgttgaaaataccttcctgaggcacctcttcattgtgcttattcttcccacaacattgtgccaagacactgtcaagcctgggcctgtcaaagcctgggatgtcaaaggcctgggtctttctcatcctgctgtaatgtattgatagctgggggctctgcagaaggacaagggaaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctaca

SEQ ID NO: 18898 - DNA, 581 bp, Homo sapiens
  ENST00000503385
gagcagtgtatccagggagaggactaattacgaggtttgaaaacctcatcaggtggctggtttctgtagcaggactaaaagactgctctcctaaattgagaacagctggggctgtgtgctagcaagtataaaagaggtggcagtggtgccccgtgtccgaaagaagtgtgtgctctctggagcctgtggagctgaagccaaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagctt

SEQ ID NO: 18899 - DNA, 459 bp, Homo sapiens
  ENST00000504754
tttcaaatgccatacaggtttattttcttactgtgtgccatttgggaccaacagagcaacggctagttttaccaagagattatatttgaatgatacctgatttggtatttcatttaaagttctggaaatgggctgggcgcagtggcccatgcctataatcccagcactttgggaggctgagtccataagtgaatggttaggaaccctaacctttacagagggaatgttttatagtttctattggcaataacagtgtaaaattgctgagaatcaaaatattgctagccacaatgccattccttctgacccccttaccctacacatacccctggagaaataatataaatttaaaacctgaaattactcctgctttcccatttccccccttattttcatagaccaccaccttttcttttgatccctactatctttctttccagtgggaaagtggctccttta

SEQ ID NO: 18900 - DNA, 490 bp, Homo sapiens
  ENST00000617975
catcagttcctccttgtgggtccgaggcgctctgccgccggcccctcctcacttcttcctccctggggatggatccaagctattgtcctgcccatggcttcccatctcaggaccctctctggccgctatcatcccagcagtggagttcagcccactactctgaaccaggcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccg

SEQ ID NO: 18901 - DNA, 2113 bp, Homo sapiens
  ENST00000536178
ggggatggatccaagctattgtcctgcccatggcttcccatctcaggaccctctctggccgctatcatcccagcagtggagttcagcccactactctgaaccagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgca

SEQ ID NO: 18902 - DNA, 965 bp, Homo sapiens
  ENST00000444095
ttggagcgcgcggagctcggctgccagagagccgcgcgggggacgcgccgggaccgcgaggagcgcaggagccttcgaggcggtgaacgagggagggagcccagtccgccgcgggccatgagccaccgggcccggggagcccggccgcggtccgggcagcgctcagccggcgccccagcccgctcggccgcagctgcgcgcctgtagccgcaggtggctgcgatgggacggaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgccctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaa

SEQ ID NO: 18903 - DNA, 2554 bp, Homo sapiens
  ENST00000635645
gagctctttcatggggtcgagttgtttagaggacttgatagtcctagcagcttctctggcctttttgtgcctcacttttcagagccgtgtcgttcttttctctggagtcaggaagcccctccataattttttttttccccactgaccaaggtccagaacagggagtgtggacacaggaatcaaggaatgttctgcagtgtgctgtcttctaacttcctgatatagatgtccagcatgccttgctgattgatgatgttcatggagatgaaaccatcctttcaggaccatggtgtgcctgaaacgacaccgcattctgacggatcagctggcgccacccagaccagaaatctgactcaactagttcaggaactgaagacagcaagaactaccccttgactccagagacggggtttcaccatgttgcccaggctggtcttgaagaactgttgagctcaagcagtccacctaccttggcctcccaaagtgctgggattacaggtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttacctaatttgtcttgaaatattccttataattccttataaaat

SEQ ID NO: 18904 - DNA, 2450 bp, Homo sapiens
  ENST00000371139
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttattta

SEQ ID NO: 18905 - DNA, 593 bp, Homo sapiens
  ENST00000360027
ttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaagggataagagaagatcctgatgtctgcctgaaagccccatgaagaaaaataaaacaccttgtactttattttctataatttaaatatatgctaagtcttatatattgtagataatacagttcggtgagctacaaatgca

SEQ ID NO: 18906 - DNA, 474 bp, Homo sapiens
  ENST00000491950
ggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgca

SEQ ID NO: 18907 - DNA, 419 bp, Homo sapiens
  ENST00000494073
ggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgca

SEQ ID NO: 18908 - DNA, 461 bp, Homo sapiens
  ENST00000477673
ggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggtatcacggttacatttatacataccgagtgtcccagacagaaacaggttcttggagtgctgagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgca

SEQ ID NO: 18909 - DNA, 3983 bp, Homo sapiens
  ENST00000339284
actaacagatcactcgacacctaccagcccaggcagggctgggactgggcatttcctggctgagctggaggcttgggcccttcccattgtctcagaaccccaggtgatgccaagacatgggctctcctgggatgccgtgcttggtgacccaggagaaggactagattgctcctggtggttgctcccccttgcagagtcccacctgcccctttgggtcctgttgcctggcctcttttgctgtcctgggtagaggagatgagttcgtcgctggctgcaagctgaggccaactgacaatgctgcacagagaaggggcaccgagagtggccccggattgagcagtccgtagtgcagagcagcccctcgggcgttctgcctggccctgcttcccctgctggctgcccttctggtgcgtgcatcccaggtggcatcatgctgcagcagatcctgcacgacatgtacatcgaccccgagctccttgccgagctcagcgatgtgcagaagcacatcctcttctacaaaatgcgggaggagcagctgaggcgctggaaggagcgggagacttgggaggccctggcccaggacgagggtctcaggcctccaaagaccaagcgagcagcgagtgacaagcacatccaatggctcctaggggcagatggcgaggtctgggtctggatcatgggagaaggccctggtgacaagccctacgaagagatctctgaggagctgattgcagagagggcgcggctgcaggcacagagggaagctgaggagctctggagacagaaggaggcagagatcaccaagaagttccgggatgctctggccaatgagaaagcccggatcttggcggagaagtggaaagtggagatggaagaccgcaaggctgccaaagtcctggaggaacgcatccacgaggaattcaagaggaaagaggaagaggagaggaagcgaggagaagagcagattcgcctccaggaagagcagagggcgaaggagctctactggaccctgaagcaggctcagctgcattgccaagccagtgagaaagaggagcgagagtgggaagaacagttgcgccggtccaaggcggctgatgaggagaggagccgccgagcccagcgcgcccgggacgagtaccgacaccactcgctccgtgctatccagaagggcacggtcgctggcctcagctccatgttccgggagcttggccagagccatgagcaggaggcaagactctaccaccacctccccgacccgggtctgccgcagccccttgccctgccggtcaggacctgggagcgcccgctgcgcccagtctccagagatgtcatcgtccgctggtttaaggaggagcagctgcctcgccgagctggcttcgagaggaacaccaagttcatcgccccctggttccatggaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccggtctacctgtctcactacatgcataaagtgaaatgatggaaggaatctgctttctgaactctaatgtgccttcattgattatcattaaaattatcattaaaattgccttatttctatggactcagaggaatgatgttttagttttggctctctgatttaccaactatgtgactttgtccaagtcatttaacttcagtaaacctcggtatgactgaaaagggagttttctgtatggccgtcactaggtttttttgtgggttagttaaatgataaacatgaaagctctgtccaaatgaaaaaggtatttctaacaacaaccacaataacaataacaacttagtgcttagcccatgatgtatcaggggatatgatgtgatgattttcaaggtgttggaggcaacttctgttccaagaactcccagcagctttgaaagcagactgagatgagttgagaccctgaatccctgggctgttgttcctgtcacccctaattaatatgtgagagacaacagctgggttttccatccctaacacatttatttcattttatttggggcctgcaatttctgcatgtctcatatattttaggttttacctttttacctggctttaaaataaatcccttgtaagttgtcctgcaaatgaaattactgtctggaaaactgcaatttcatcttgagagttttattatgctaataaatgtcaggattctcatat

SEQ ID NO: 18910 - DNA, 2889 bp, Homo sapiens
  ENST00000313455
aaagcagccgtgccgtgtcccagggcgggaattgtgcggggacgggctccacggaggaatcttctcttccttcccttgatgttgccagaggactcaggaggctctccagatgctgcagcgagtgacaagcacatccaatggctcctaggggcagatggcgaggtctgggtctggatcatgggagaaggccctggtgacaagccctacgaagagatctctgaggagctgattgcagagagggcgcggctgcaggcacagagggaagctgaggagctctggagacagaaggaggcagagatcaccaagaagttccgggatgctctggccaatgagaaagcccggatcttggcggagaagtggaaagtggagatggaagaccgcaaggctgccaaagtcctggaggaacgcatccacgaggaattcaagaggaaagaggaagaggagaggaagcgaggagaagagcagattcgcctccaggaagagcagagggcgaaggagctctactggaccctgaagcaggctcagctgcattgccaagccagtgagaaagaggagcgagagtgggaagaacagttgcgccggtccaaggcggctgatgaggagaggagccgccgagcccagcgcgcccgggacgagtaccgacaccactcgctccgtgctatccagaagggcacggtcgctggcctcagctccatgttccgggagcttggccagagccatgagcaggaggcaagactctaccaccacctccccgacccgggtctgccgcagccccttgccctgccggtcagcaggacctgggagcgcccgctgcgcccagtctccagagatgtcatcgtccgctggtttaaggaggagcagctgcctcgccgagctggcttcgagaggaacaccaagttcatcgccccctggttccatggaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccggtctacctgtctcactacatgcataaagtgaaatgatggaaggaatctgctttctgaactctaatgtgccttcattgattatcattaaaattatcattaaaattgccttatttctatgg

SEQ ID NO: 18911 - DNA, 2896 bp, Homo sapiens
  ENST00000372150
atgtggaagaagaggctgggtgaagcaggctgccctgcactgcttaatgaagaagaaagacatctgaggttactgagaaggaagagtgtgaggactgggaacacaggctggctctctgtagggctgtagggggtaaaggaaagcccagagtggcagcgagtgggaagacaggggctggaggccaactccacagatgacagctcaggacctgggagcgcccgctgcgcccagtctccagagatgtcatcgtccgctggtttaaggaggagcagctgcctcgccgagctggcttcgagaggaacaccaagttcatcgccccctggttccatggaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccggtctacctgtctcactacatgcataaagtgaaatgatggaaggaatctgctttctgaactctaatgtgccttcattgattatcattaaaattatcattaaaattgccttatttctatggactcagaggaatgatgttttagttttggctctctgatttaccaactatgtgactttgtccaagtcatttaacttcagtaaacctcggtatgactgaaaagggagttttctgtatggccgtcactaggtttttttgtgggttagttaaatgataaacatgaaagctctgtccaaatgaaaaaggtatttctaacaacaaccacaataacaataacaacttagtgcttagcccatgatgtatcaggggatatgatgtgatgattttcaaggtgttggaggcaacttctgttccaagaactcccagcagctttgaaagcagactgagatgagttgagaccctgaatccctgggctgttgttcctgtcacccctaattaatatgtgagagacaacagctgggttttccatccctaacacatttatttcattttatttggggcctgcaatttctgcatgtctcatatattttaggttttacctttttacctggctttaaaataaatcccttgtaagttgtcctgcaaatgaaattactgtctggaaaactgcaatttcatcttgagagttttattatgctaataaatgtcaggattctcat

SEQ ID NO: 18912 - DNA, 2626 bp, Homo sapiens
  ENST00000481537
ctgattaccactgatgctgaggatcttttcacacgtttcacggccacttggatttcttctgaggaaattatcactgtttcaggaggagagttacttcaggaaccctgcggacagagggacagcccaccagactaccatctgttgtttgaataatttttttccttatcaattggattcattttggtatcctgtttttgaactcagcttaagaacttctcatctcaaatcctatggccttctggaagatccaccactatccaaaggaaaaagtagattaatatgcctcaagggatatgacatctatggcatagggctactggtctcatcccagcgatcgggacagaaattgctaatagctcatgcaactctttcatgaagagcttagctatgaccttagaagacaaagcctgtttgtcatggctgccgtaaaccgagctcttacagtgcgtggaccatgttttaataatccaaaataattccagtgccgaaccctgaatttaacatatggtagacattcagtaaatgtttgttgaatgaatgcatgtcttctaaaagttttccaacacaaattagcagtggtttcttgtaaattatttcctactcgccactctataaaatcatggcaataatagaagattatgaaggatttctatggaggacataaatgctgcatctttcataatctccattatcaccctcattgatattatcattggaattatctaaggtgagccccagtttccagggcagctgattgacaccgtcctgccttccttatttaacctcttcttttgccactcgcctctatctttgaatcatattttggccttggttttgcaatggttttatgtcatcctacagatgtcttcaagacctggggtgagttatcaatgcaagaatggttcttagaaatctgatgaggcctctgctctctgggatgtggccctctctatgcaggttactccaatgattagctctgtcctcattgtccttttaattcccttgtcaacttaatctcagtatgttgcttatattaacaagaagactcacgcaataactcctcgataactctcagtgatggtatctgttggtgcatacttgtgttccacagttatggccatatacacagaggtagtatatgatgaagagaagattacagtctttacagtcaagaagacttgggttcatatcctaaccctggaacttactagcattataatgcttgcagcattgtgtttggtgagaggaaaagaatgaatggattctaggaatgttagggaacgatttactttacccgatggctgtatcaaacatctatgccccacttcttctcttgcctcacctattccttagattcttggtcacttctctaccacaagccaccagcactataaccagttttgcgtgggttctgctcttcctccctatgttgatcagtgtcatgtgagcataagccaatggtagcttgccacatgccccatctcccattgctgcagaggcataagacagaagagatgggaagtgaatgcccgatgtggtgaatctgggatgaatgggagtcataggctggtagatcgctttttcctccttcttcctcctggaggaactattctgagagtcatctgtttgtatggtcttgtagaagacagtcctgtaagatcgagcaaccagtcatgatgaaaccaagtggtggccggatcagtatgacaccctgctgcccccgtttttaattcttctctgccttgccctgctctctcctgttgctctgggattgcacttctgaatgaagtagcagctcataagcttttgccacaggctctgtcttttggggaatccaggataagaacccattatacagaagtgttcaataatatcaattttgcaactcactcagctccatggcttcccccggtctacctgtctcactacatgcataaagtgaaatgatggaaggaatctgctttctgaactctaatgtgccttcattgattatcattaaaattatcattaaaattgccttatttctatggactcagaggaatgatgttttagttttggctctctgatttaccaactatgtgactttgtccaagtcatttaacttcagtaaacctcggtatgactgaaaagggagttttctgtatggccgtcactaggtttttttgtgggttagttaaatgataaacatgaaagctctgtccaaatgaaaaaggtatttctaacaacaaccacaataacaataacaacttagtgcttagcccatgatgtatcaggggatatgatgtgatgattttcaaggtgttggaggcaacttctgttccaagaactcccagcagctttgaaagcagactgagatgagttgagaccctgaatccctgggctgttgttcctgtcacccctaattaatatgtgagagacaacagctgggttttccatccctaacacatttatttcattttatttggggcctgcaatttctgcatgtctcatatattttaggttttacctttttacctggctttaaaataaatcccttgtaagttgtcctgcaaatgaaattactgtctggaaaactgcaatttcatcttgagagttttattatgctaataaatgtcaggattctcat

SEQ ID NO: 18913 - DNA, 4653 bp, Homo sapiens
  ENST00000369838
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggtggccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccagaacagaaggagggtggaggaagtgatcagagggaacgagctgtaggtttgcagaaatgtgtgaaaccaaaatgatcactgcctacttgtgattcaaatcttcagagttttcctagttcttctagaaatacatgtcaggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactgaatgta

SEQ ID NO: 18914 - DNA, 2265 bp, Homo sapiens
  ENST00000452765
gggcgcgggcgggacggagctgcggcggcggcgggtcccgcgggcgggagcgcctggcggccgagtcaagccgccgcctcgacccagggcccgcgggccaggagagcgctcggcggcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttg

SEQ ID NO: 18915 - DNA, 551 bp, Homo sapiens
  ENST00000503219
agcgcctggcggccgagtcaagccgccgcctcgacccagggcccgcgggccaggagagcgctcggcgggctgacccttggccctctgcctgccctgctggctggctcccactcatcctgcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccag

SEQ ID NO: 18916 - DNA, 615 bp, Homo sapiens
  ENST00000512131
gcgcctggcggccgagtcaagccgccgcctcgacccagggcccgcgggccaggagagcgctcggcggcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagag

SEQ ID NO: 18917 - DNA, 407 bp, Homo sapiens
  ENST00000510193
aaagccgcccactggcgctgattcacactgaagtgtgacatgggccggtgatgcaatgtgtagaattgtttccacaaccgcctgaaggcagggcccacagcctcctccttgccgaagcaagcctctgggttcaggctctgtaacttccaaggccatgagagtggtcaggccctgcttggtttcccggcccccgatcacagatcgtgctggaactgctggccccaacgccctgaggtgactggccctttcttcatggattccggtcacatctggtccatctttgtcagctggcctctgggaagaatgtgggctcggccacctggagcagttgcctggggagatcagaggagccctgaggggttggcagagcgccctcgtggtatccatacccccatccctgtagctga

SEQ ID NO: 18918 - DNA, 517 bp, Homo sapiens
  ENST00000511237
gcaggtgacatgggccggtgatgcaatgtgtagaattgtttccacaaccgcctgaaggcagggcccacagcctcctccttgccgaagcaagcctctgggttcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgca

SEQ ID NO: 18919 - DNA, 649 bp, Homo sapiens
  ENST00000510074
gcaggtgacatgggccggtgatgcaatgtgtagaattgtttccacaaccgcctgaaggcagggcccacagcctcctccttgccgaagcaagcctctgggttcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgccca

SEQ ID NO: 18920 - DNA, 557 bp, Homo sapiens
  ENST00000504294
actcgaggccagaaagggaagcccctttccagtgggcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaag

SEQ ID NO: 18921 - DNA, 876 bp, Homo sapiens
  ENST00000508385
acggggcctgggaaactccaaagccggcgtcaggtcatcgaggcctccgggctgattaggactaatggcgctcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactcc

SEQ ID NO: 18922 - DNA, 868 bp, Homo sapiens
  ENST00000513020
tcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacagggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccaggtgagcccgggcccagggcatacc

SEQ ID NO: 18923 - DNA, 966 bp, Homo sapiens
  ENST00000511663
gctgacccttggccctctgcctgccctgctggctggctcccactcatcctgcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaa

SEQ ID NO: 18924 - DNA, 688 bp, Homo sapiens
  ENST00000512014
cttgaaattcatagaaccgggtgcaagacataacagccctctgtgtggcctcagatggcagagcagggtggcagcagctgccctggcaggaagagcatgctgcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggctt

SEQ ID NO: 18925 - DNA, 609 bp, Homo sapiens
  ENST00000513095
aaatgctgctctgtgctgggcctgacacccagggtgcaggttgtttcatggtttgctagggagaagccgagtattcagaggtggccctgcggggaggcagcagggagcttcctcccagggatgcagctgaccttgcgctggagccagagagccctggcctctgaccacaggatgggagggcaggagcagtggaagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaaga

SEQ ID NO: 18926 - DNA, 727 bp, Homo sapiens
  ENST00000502260
cagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagctcctgcccatgttaactcagccgacaccgcagcagcatggtgacaggtccccccagggtgtctgcctctacagaggaagggactgaagcacccagagagctggcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccag

SEQ ID NO: 18927 - DNA, 1071 bp, Homo sapiens
  ENST00000511185
ggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccagcgactccagctcggacacagacagcttctacggcgcagttgagcggcctgtggatatcagcctttcc

SEQ ID NO: 18928 - DNA, 2318 bp, Homo sapiens
  ENST00000435136
gtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttg

SEQ ID NO: 18929 - DNA, 491 bp, Homo sapiens
  ENST00000508338
gacaccgcagcagcatggtgacaggtccccccagggtgtctgcctctacagaggaagggactgaagcacccagagagctggcaggtgccgttttgcagaggccactttcccgagggagctggttgcaagggcccggcgggatgggacctgggcggggcctcagagccgaggctcccgcgccggccgtggatttccaaccaagctgtgtggactggcaggtgttgggggagtggagcgggaggcctcgtttgcatcgaaggcttcttgattccaggctgcaccaacagatgtgggcctcctgtcccaagcgcccaccaacctccttgcagcgtggggaaactgaggcccgcagggggctcacgtgcctcccgcgcacggtgacgcggcagggggcggggccgggaggggcgcgccgggatcctcacctgcccgcccagtcccccgccgagaggggaggagccggcggctgccaggccagggccggcgggcat

SEQ ID NO: 18930 - DNA, 2351 bp, Homo sapiens
  ENST00000511747
ggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgc

SEQ ID NO: 18931 - DNA, 1087 bp, Homo sapiens
  ENST00000509677
ccttggcctgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcc

SEQ ID NO: 18932 - DNA, 2579 bp, Homo sapiens
  ENST00000515737
cagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcagggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagcttt

SEQ ID NO: 18933 - DNA, 9211 bp, Homo sapiens
  ENST00000356331
cagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactatagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctaca

SEQ ID NO: 18934 - DNA, 537 bp, Homo sapiens
  ENST00000506932
cagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcagggtgatgcgggcggctgaggagaccacgtccaacaacgttttccccttcaagatcatccatatcagcaagaagcaccgcacgtggttcttctcggcctcctccgaggaggagcgcaaggtgactgggggtccgaggacgagtgcaaggtgactgggggtgtgggcctgca

SEQ ID NO: 18935 - DNA, 566 bp, Homo sapiens
  ENST00000515183
atcatccatatcagcaagaagcaccgcacgtggttcttctcggcctcctccgaggaggagcgcaaggtgactgggggtccgaggacgagtgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaagg

SEQ ID NO: 18936 - DNA, 917 bp, Homo sapiens
  ENST00000505941
gagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaacatgctgtcctgggaggtgcccctgtgggctgaggggagccacacagccatgttgtatccagccgggtcgcctcctctgaccttgggagtcacagcagagcaggcagggcagtgaaggtggaggggtgcggtggggcccaccctggtggcaccgtgcccaccacagccccgctgacctgcagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagag

SEQ ID NO: 18937 - DNA, 3617 bp, Homo sapiens
  ENST00000510204
ttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagaggacagaaagccaggcttgggagcggggcgggaaggtccgtgtgaaagctgcccgaggaggactcacccgctaatatgactgtcttattttaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgggccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgc

SEQ ID NO: 18938 - DNA, 2247 bp, Homo sapiens
  ENST00000515802
gtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgc

SEQ ID NO: 18939 - DNA, 844 bp, Homo sapiens
  ENST00000504450
acagagtccttgtgtctgtgtgtctacatgtctgcgcgtgtccctgtgtctttgtgtatatatatccatgcctgtgtgcctgtgttcctgcgtgtgcttgtgtgtgcacgtgtgcatttgtgtgtttgtcagagtatgtgtgcatgtgtgtgtctgtcagcgtatccatgtgtgcatgtgtgtgtctgtcagcgtatccgtgtgtgcatgtgtgtgtctgtcagcttaaccatgtgtgcatgtgtttgtcagtgtatccgtgtgtgcatctgtgtatctgtccatgtatccgcgtgtgcctgtgtgtacctttgtgtgagcatcaagggacctcccaggcctggtgctcaccgtccgccccaacgcaccctgcattgcagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgagggcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaa

SEQ ID NO: 18940 - DNA, 866 bp, Homo sapiens
  ENST00000513069
ccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtg

SEQ ID NO: 18941 - DNA, 9211 bp, Homo sapiens
  ENST00000442312
acttggtgctgcccagggagcagggaacaggaagtcccgggtggggaggaagcaccggcggccacaggcctcagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcagcttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 18942 - DNA, 9158 bp, Homo sapiens
  ENST00000503393
ggggaggagccggcggctgccaggccagggccggcgggcatggcgggctccgggccgcggccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgcccttcatggcggctgaagagatgcattggcctgtccctatgaaggccattggtgcccagaacctgctaaccatgcctgggggcgtggccaaggctggctacctgcacaagaagggcggtacccagctgcagctgctgaaatggcccctgcgctttgtcatcatccacaaacgctgcgtctactacttcaagagtagcacctctgcctccccgcagggcgccttctccctgagtggctataaccgggtgatgcgggcggctgaggagaccacgtccaacaacgttttccccttcaagatcatccatatcagcaagaagcaccgcacgtggttcttctcggcctcctccgaggaggagcgcaagagctggatggccttgctgcgcagggagattggccacttccacgaaaagaaagacctgcccttggacaccagcgactccagctcggacacagacagcttctacggcgcagttgagcggcctgtggatatcagcctttccccgtaccccacggacaatgaagactatgagcacgacgatgaggatgactcctacctggagcctgactccccggagcccggaaggcttgaggatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggctgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagcgatcaccccccgatgggcagagtttcaggagcttctcctttgaaaagccccggcaaccctcacaggctgacactggcggggacgactcggacgaggactatgagaaggtgccactgcccaactcggtcttcgtcaacaccacggagtcctgcgaagtggaaaggttgttcaaggctacaagcccccggggagagccccaggatggactctactgcatccggaactcctctaccaagtcggggaaggtcctggttgtgtgggacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctacgatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctggaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgagctagtgagtggtgcagtccaggacacctttgctttatgtcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgcgttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccagcagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccagccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgcta

SEQ ID NO: 18943 - DNA, 5194 bp, Homo sapiens
  ENST00000392011
cgcccaggcgcgggaccaccctccgcccgccgaggcgggggcccagcgcgcccggcactctcggcggtccgggcccctcgccactaccgccgccgccgccgccgtgagtcccgcggagccgcgcgcgcccccggctgggccgagccgctggccgacgagcggagcctcaggagccggcggggacgccatgcgagccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaa

SEQ ID NO: 18944 - DNA, 612 bp, Homo sapiens
  ENST00000484097
ggcggtccgggcccctcgccactaccgccgccgccgccgccgtgagtcccgcggagccgcgcgcgcccccggctgggccgagccgctggccgacgagcggagcctcaggagccggcggggacgccatgcgagccagatccctcctgtgaggatgaaattgaaaactccggtttctggcttggcgatcgggtgaccgagcagccgcgaggtgacagcgccggcggcccgcgggcggggaccggctgggatagaggcgcgttgttctctgagcgatgtttaccgagaagcccgctccgcggcacgggcgggtgtcagttgggaccccaaccctgggtcccgcggctcctagcccggggcctgcggtgtagacgggggttggggacaggcccagctggccctgaccgggtgtcgggcgcccagagatgccgcgcgggaggagccgcgggagagccgccggactcagcgagcagagggtcgtggagcctgatggatcgatgagatctgaaaaagaacactgtgcgagattgtattcctgcttattctttccaagttagtaggcagattggaactatagaatttatccgtgataataataaagttcgcataactttt

SEQ ID NO: 18945 - DNA, 593 bp, Homo sapiens
  ENST00000416021
gtgagtcccgcggagccgcgcgcgcccccggctgggccgagccgctggccgacgagcggagcctcaggagccggcggggacgccatgcgagccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagc

SEQ ID NO: 18946 - DNA, 5231 bp, Homo sapiens
  ENST00000409212
accttaagagggacaactgaaacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccaggtcaggctggaggcttttgcatttggtttggcgaggagagacagcaggatttctgggtgccggacatgcttctcggtcagagctgcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaa

SEQ ID NO: 18947 - DNA, 638 bp, Homo sapiens
  ENST00000489601
actgaaacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccagtatcttttgtggctggcagactctgagatggccttcagtgatccacacctcctggtgttcacatcctgtgaagtcccctccctttggcgtgagccgagctagcaacttgcttctaaccagtaggatgcatccaagttgatgctgtgccttcctcccgtgattacattatgtgggcttagaacttcttccttgacaacagatggtctcccctgctggctgtggtggagcaggctgccatatagagaggccatgtggcaaggaactgagggtggcctcccccggcagccagcatgcagttgaagcctcagtcccatggccacaagtaactggatgctacaacaagcagatgaccctggaggacccctcccccagatgaccctggaggacccctccccagtctagccttgagatgacaccccagcctgggccaagacttt

SEQ ID NO: 18948 - DNA, 5044 bp, Homo sapiens
  ENST00000344528
gaaacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccagcgtctcccttctctcctggacagaaggccgtgtcctgggacttctctgatggcgagaggctgcggctgtaccaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaa

SEQ ID NO: 18949 - DNA, 570 bp, Homo sapiens
  ENST00000444916
aacagagacaagcaccccaacagtagggtgcttcgaggtcctggaggggagccctggccctgtggagagagaccgagtcgtgcagcgtccgtggcctgcatttgaaactgaagggcaagaggctggtgagatccgagagtcatgccgctgcgtggaggaacatgctgaacctctggaggaacggctctacctccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaat

SEQ ID NO: 18950 - DNA, 829 bp, Homo sapiens
  ENST00000446904
cgcagttggctggtgtttgtttgcacaaggattctttggtaacaatctgcagtcggtttctggcggaatgtgaggtgaagtcacgactgactttcgggatggagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatggg

SEQ ID NO: 18951 - DNA, 257 bp, Homo sapiens
  ENST00000462602
tggtgtttgtttgcacaaggattctttggtaacaatctgcagtcggtttctggcggaatgtgaggtgaagtcacgactgactttcgggatggagatttgtgcttgagaagctctgagttcccgtctgtccacctgcattggcatatggcgtctcccttctctcctggacagaaggccgtgtcctgggacttctctgatggcgagaggctgcggctgtaccagttggagacaagaaagaagcttctccaagctcccct

SEQ ID NO: 18952 - DNA, 481 bp, Homo sapiens
  ENST00000493436
cagttccgtctgtcgcattgatgttggctggttctgctctcaaaggcgccggctctgtagtgatgtcagcgccgtgtgacttgaggaggagaccccactgctgcgcgtctcccttctctcctggacagaaggccgtgtcctgggacttctctgatggcgagaggctgcggctgtaccagcgaatccactttctgttgccacccgtggaacgttctcactcttccaagaagccaggctagcagctcccccaccccagcagccgcgggacagagcccaggttgggtggtgtgtacacaaaggagggattgttctcacgtcgccctgcgacgagatggggatggacccgcggttagaggtcaccctccctggggcgtcaggggagcatttgtccttgaaacacgctggcaaaaaatgttccaaggaagcctcagctggtgtttgtgaggaagagctggattaaatggtgttctggtaaaatgtt

SEQ ID NO: 18953 - DNA, 500 bp, Homo sapiens
  ENST00000454947
agcacagcagcaggggaagaggacagtgaggctgggatgcagcctccatgcagcctgtcgctttctccacaggagctctggcctgggccagactgccgagtcaccctgattcaggagtaggcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaa

SEQ ID NO: 18954 - DNA, 503 bp, Homo sapiens
  ENST00000604922
agagtttcatatgctggaccacattttagcttttattgttttttttttcccattgtccaaaaagttaagcaacaagtggccacacttttacgtgactacaacctggagttctgcaaagaaggaataatccaatactcaaggttgtgttgtgtgaggaagcaaagaaacacttacaatttattgaccacttctttcaagtcatttgtctgcacctctcgggtcatgatttccatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctggagaaaaaagataccgtcagatttaacaggttttacgttatccatttatccctcaagttctaattttaaaaagctggattgtcaaacactcattattaaatataaagtatcctaaca

SEQ ID NO: 18955 - DNA, 5284 bp, Homo sapiens
  ENST00000409598
gaaatccaacttctgaaatgttctgggtggtagatagttaagggtgaagctgtattggtcttagtatttgcagatgttgtagctgactgctcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtccc

SEQ ID NO: 18956 - DNA, 4888 bp, Homo sapiens
  ENST00000409252
ccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaa

SEQ ID NO: 18957 - DNA, 4038 bp, Homo sapiens
  ENST00000478503
tcggttaagatggaggaatgccgagtcatatatccttcccccaaaattaaatatttgaagggatatgtcttattttatttctgggatagaatgtttttcattttcatgttactgaagtgtagttttactaaactactaaatcggagactgctaagcaccttccctgtgccaggcacagcactgggtagggtgagggccctgggagtaaatattctgggacaggcacagggggtgtacagggaaagagtctttcctctctgtggcatctgggaggctttaggatgtgggaaagatggtctcctcatctcagttgcccctcattttcaggcagacacgtatgaaatgattacactcccctgaaagatcagcttctacataattcaagatcatcctcaatctctctcatcagagaggaagaaaagccgcatgaattatttacagaacactaagttatttccttttatgagctccaactttgtttttgtctctgcaaactgagattttgtttatccatgaatagtttccccaggggcatgaaaaatatgactcttaaattatgaatgaggttttttgtttcagtccatgttaactaaaacatgcaaaataaactatgtttttcattagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttc

SEQ ID NO: 18958 - DNA, 5107 bp, Homo sapiens
  ENST00000514152
agccatttgcttcctgagtggccacattccagctgtgcagactggtcatagcacatctgccaatcagaacaggccctggagggaagcccttggatactgagtcttgtttacatgcatcgtgactctgtttctcccttcctcttgtgtgttgtaccactaggaagattagtggggaaatttgctattacatgcctaagtaaactatgtaactaggatcacagccacaggaaatgatgttctggacagagttttagctcggctttagccacagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttc

SEQ ID NO: 18959 - DNA, 5228 bp, Homo sapiens
  ENST00000604030
agagcgggagtgggagtgggaaaggccagggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttc

SEQ ID NO: 18960 - DNA, 2656 bp, Homo sapiens
  ENST00000427414
cccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggc

SEQ ID NO: 18961 - DNA, 698 bp, Homo sapiens
  ENST00000508492
tttagctgctggagaaggtgcactttaggcacacacatgccaaattcctaaatgatcagcaacttaagaggaggttatttgattgtgaataagccttttattggtttacgtttaagctgtctgtgcctcatggaattgccaatgaagatattgtctctcaaaaccccggagaactctcttgtaaggtaaagtagagctctttccttactggttaatgtaaaaaaaaaattactggcctctgttactaccattacacattattaaatgctttaggctccaaagattaaaatgtgaaaaagtaataatgttttattaaataataattgcttcagagagtggtattgtaccttgcagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgat

SEQ ID NO: 18962 - DNA, 882 bp, Homo sapiens
  ENST00000462257
aaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagaccatgtggaggcattacctttaacaagagagttaatcaataatctttttaaaagagctgaacataagcataattaggctgaaagaaactgggagaattatctcttgtcgtctttgccacttctgaagaactgcttcccccaatgaccctcagattctgataagtaaaaatttttaaaataataaaatagtgatttatctaaatggttatattattcaaggttacaaatagaagctacttgttatgaactaaatatgcc

SEQ ID NO: 18963 - DNA, 555 bp, Homo sapiens
  ENST00000604440
gattccatgctgactatcctccgtcttaatcctggttttcttcaaccagtgcataatactgttgattagatttaaactttcatcggtacgatctcattcctagtacgttgccttaagattatacccaagtctccaagattaccttcttcctaaaacatgagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaaga

SEQ ID NO: 18964 - DNA, 659 bp, Homo sapiens
  ENST00000474743
atgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcactcatgaatagtacacagcaaaaatgccccgtggaagagcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataat

SEQ ID NO: 18965 - DNA, 557 bp, Homo sapiens
  ENST00000514013
gcatcgtgactctgtttctcccttcctcttgtgtgttgtaccactaggaagattagtggggaaatttgctattacatgcctaagtaaactatgtaactaggatcacagccacaggaaatgatgttctggacagagttttagctcggctttagccacaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaat

SEQ ID NO: 18966 - DNA, 5273 bp, Homo sapiens
  ENST00000304527
tcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagttttgttttggtctcgtcagcactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtc

SEQ ID NO: 18967 - DNA, 1170 bp, Homo sapiens
  ENST00000492099
gcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccaggtaaagttgaaatattctcttgttcatttgctgtcacagactctaataacccatgtttacttggtgtttagttgacataatgtagaaacaatgtcgtctgtgtcccaataatgaaattcagtttttaaagctgagtctccagtgaccaaaggtagttgcattcggtcctactgatgagaaagagaacagctatttttgtgaatttcagttgacatcatccgaatggagtgctggtcatagcaacaagagagcactgagcaaaggttttatgagttgcttcagaaagccactaaacatttggcaaatattttcttccttatttcctctttataatttttttaaaaattctgcccttgtgtactatatacataaaggtatatgttaatttgaaaaagctttctctttgtggcttaaatgctggagaaacaagatgtggtgaatacgaaaggctgcttaaatccagtgtcacatcagcttctccactgaaggtctgggtttctaggtccccaagcagcatctattgatgagattttcccaggttgtaaattataggaaccaatagagggcgcccaagctttgagttctgtggatttctaaagccacctttcctttttaggaatttattatctgcgtagagttcctgtgattcccttgactgtaggaatcagcacaaacct

SEQ ID NO: 18968 - DNA, 1806 bp, Homo sapiens
  ENST00000427482
gcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaaaa

SEQ ID NO: 18969 - DNA, 1647 bp, Homo sapiens
  ENST00000563901
gtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggc

SEQ ID NO: 18970 - DNA, 2012 bp, Homo sapiens
  ENST00000324537
gcgatgtcggtggccgggctgaagaagcagttccacaaagccagccagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggttatgaggctggttcttgggtttgactctgggaatcatgctcattgatctgcttttcctaatcatgtcagtgaatacctacacgtgaagaaaactcaagctgcaccataaagctaaaggaagaaggagcttttaagtgaataagaccattttcccaatgagcagtgtcataaacattgaggactctcttaaatcagaagatgaatgaatggatggaatctttgctgggataatatgcaatcaagctaataggtgccttacctggacctcccaacagctatttagtgaaaaaataagtggtgctgaaggaactaaactagacgatgaatttcttgacatggaaaggaaaatagatgttaccaataaagttgttgcagaaattctttcaaaaaccactgaatatcttcagccaaatccagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggcaatgcattgatagaagttggtgaatccatgaagctaatggctgaggtgaaagactctcttgatattaatgtaaagcaaacttttattgatccacttcagttactacaagataaagatttaaaagagatcgggcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtagaacaagtcagccagttggctgtgttcatagaggcagcattagactatcacagacagtccacagagattctgcaggagctgcagagcaagctacagatgcgaatatcagctgcatccagtgtccccagacgagaatacaagccaaggcctgtgaaaaggagttctagtgagctcaatggagtttccaccacctctgtagtgaagacgacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggc

SEQ ID NO: 18971 - DNA, 758 bp, Homo sapiens
  ENST00000564054
cctacagcagactggaaccagcagattaggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattt

SEQ ID NO: 18972 - DNA, 458 bp, Homo sapiens
  ENST00000467735
acaaaaacactcaaaagacacagcagtctgggggatttactaaaagacaaagagccctactcaggtctcaggagtaagagaaaatcaacacaaggccacttggggagggcagtgctggctgaagccgtctcactggacagcccagggtcaggggtttcagccgcctgttcaaggacaccgagatccacagcagccacctgggagctcctacacaactatgcccagcgattccaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactct

SEQ ID NO: 18973 - DNA, 5272 bp, Homo sapiens
  ENST00000284637
cgccccgggcgccggctgcgtcccggcctcctcctcctcttcctccgccctccttggctgggaaagtgggaggcggcggcggcggcgtggtgtgtgtgcgcgcgtgaggggggcagcagagaggagtctcccggtgccgccgcggcgtcagagacactgcgagcggcgagcgcggtggggccgcatctgcatcagccgccgcagccgctgcggggccgcgaacaaagaggaggagccgaggcgcgagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctcagagcagcactgtggctaattgtagctcaaaagatctgcagagctcccagggcggacagcagcctcgggtgcaatcctggagccccccagtgaggggtatacctcagttaccatgtgccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaagaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtagcacaaagcagtttaacagaaagagcacatttgtggacttccagatggtcaggagatgagcaaaggattggtatgtgactctgatgccccagcacagttaccccagcgagcagaatgaagaagatgtttgtgtgggttttgttagtctggattcggatgtataaggtgtgccttgtactgtctgatttactacacagagaaacttttttttttttttaagatatatgactaaaatggacaattgtttacaaggcttaactaatttatttgcttttttaaacttgaacttttcgtataatagatacgttctttggattatgattttaagaaattattaatttatgaaatgataggtaaggagaagctggattatctcctgttgagagcaagagattcgttttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagtgactgaaacaatgagaaagaatacagcacaacccttgaacaaaatgtatttagaaatatatttagttttatagcagaagcagctcaattgtttggttggaaagtaggggaaattgaagttgtagtcactgtctgagaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcattagtgaaagtggtcttttatgtcctcccagcagacagacatcaaggatgagttaaccaggagactactcctgtgactgtggagctctggaaggcttggtgggagtgaatttgcccacaccttacaattgtggcaggatccagaagagcctgtctttttatatccattccttgatgtcattggcctctcccaccgatttcattacggtgccacgcagtcatggatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaaccttttttttaaaaaaaaacaatgtatattatgttcctgtgtgttgaatttaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgattgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcgatttatcactccttttcatgttaataatttgaggactggataaaaggtttcaagattaaaatttgatgttcaaacctttgt

SEQ ID NO: 18974 - DNA, 1657 bp, Homo sapiens
  ENST00000511421
ccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggagcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaa

SEQ ID NO: 18975 - DNA, 2020 bp, Homo sapiens
  ENST00000508685
cgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctcagagcagcactgtggctaattgtagctcaaaagatctgcagagctcccagggcggacagcagcctcgggtgcaatcctggagccccccagtgaggggtatacctcagttaccatgtgccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaa

SEQ ID NO: 18976 - DNA, 487 bp, Homo sapiens
  ENST00000502315
gcggccggcgcggggtcgacggggacccagcgtcggcggacccctagccgcggagaaggcggtggtctcgacattcccccatccccgccctggagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctca

SEQ ID NO: 18977 - DNA, 591 bp, Homo sapiens
  ENST00000510806
cagagtttatcaactactgccctgaagggcgcttttctgttttagctgctttcaagcaaatctgtgtcttttagaattgtcaaccttcagctctttttggttgggcaaaattaaacagttctatttttaataacagcgaagaaacatatgtatttaatattgggatcatttaccacgagcgattacatgaggcatggtttcttaaacgctaaagtggcttaaaaaagggaatttagttggatataaaagtaaatttcagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagagg

SEQ ID NO: 18978 - DNA, 5803 bp, Homo sapiens
  ENST00000309415
ccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccgcggccgcgggcagcaccgccggcagtctgcgggagctggcgaccagcaggaccgcgccggcggcaaagaatccctgcctgcttccctatggcaaggccctctacagctacgaggggaaggaacctggtgacctcaagttcaacaagggggacatcatcgtcctgcggcgcaaggtggatgaacagtggtaccacggcgagctgcacggcacacagggcttcctcccagccagctatatccagtgcatccagcccttgccacacgccccgccccagggaaaagcactttatgatttcgagatgaaggacaaagaccaagacaaggactgtctgaccttcaccaaggacgagattctgacggtgctcaggagagtggatgagaactgggcggaaggcatgctgggagacaagatcgggatcttcccgctcctgtacgtggagctcaatgactccgccaagcagctcattgagatggacaagccatgcccagccgctgcatccagctgcaatgcctccctgccctctgactccggcgctgtggccagcgtggccccaagtcccactttaagcagctcaggggcggtcagtgcctttcagcggcgtgtggatggcaagaagaacaccaagaaacgccactccttcaccgcgctcagtgtgacgcacagatcctcccaggctgccagccacaggcattccatggaaattagtgctccagtgttgatcagctccagcgatccccgagccgcggccaggattggagaccttgctcatctgtcgtgcgctgctcccacccaggatgtctcctcctcggcgggatctacccccacggctgtcccacgggctgcctcggtgtctggagagcagggcacgcctcccaaggtccagctgcccctcaacgtgtacctggcgctctacgcctacaagccccagaagagtgacgagctggagctgcacaagggagagatgtaccgggtcctcgagaagtgtcaggatggctggttcaagggggcgtctctgaggaccggggtctctggggtgttccccggaaactacgtgacacccgtttccagggtgcctgcaggaggggcagggccgccccggaataatgtagtcggagggtctccactggccaaagggataaccacaaccatgcacccaggcagtgggagtctgagcagcctggccactgccaccaggcccgccctgcccatcaccactccccaggcccacgcccagcaccccacagcctcgcccccaacaggcagctgtctacggcactcagcccagccaacggccagccaagcccggagcaccatttcaacagctgcccactctgcagcccaggctcaggaccggccaactgccaccgtgtcacccctgcgcacccagaactctccatcccgcctgcctgccaccagcctcaggccccactcggtggtgtccccgcagcacagccaccagcccccggtgcagatgtgcccacggccggccatccccctcacatcagcagcatcagccatcacacctcccaacgtcagtgccgcaaacctcaacggggaggctggaggggggcccatcggtgttctgtccacatccagccccaccaacacgggatgcaaactagacgagaagaaaagtgaaaagaaagagaagaagagtgggctcctgaagcttctagccggagcatccaccaagaagaagtcacgctccccgccatctgtgtctccaacccacgacccccaggtggccgtggacgccctgctccaaggtgcagtgggccccgaagtgtcctcactgtccatccacggcagggcagggtcctgccccatagagagcgagatgcagggtgccatggggatggagcctctgcacaggaaggcaggctccttggatctaaacttcacatctccttcccggcaagctccgctgtccatggctgccatccgccccgagcccaagctgttgcccagagagaggtaccgcgtggtggtctcgtacccaccccagagtgaggcggagatcgagctgaaggaaggcgacatcgtctttgtgcacaagaagcgtgaggacggctggtacaaggggaccctgcagcggaacggccgcacaggcctcttcccgggcagcttcgtcgagagcttctgagaactggtgctccctgcacccagctcacagagggggaggccgcctgggaagctccacggcacacagagagggagccatggcgccccaagggttccaggtcatctccaaggcacctggcgggggataccctggcccagggtgggggccagggactgtggaggtcgtgccttctcccaaaacccccaaacggagagcacacctgggatgttcttcaaggaaatgcccaccccctctgtggaaactgcaaagaaagcaccttgaggaagagaggcaggtgccggcgcaggcaggcctgtggctgtggtttgcagccatggcagcgttctcatttaccacctaagcagggttggaggttgcaggaggtctgcaggcgaggtgggtggcatgggggccaggagcgctggagatcatctttctgggctgccctgggcttcccgcggggcccaggttgctctgtcaccattctatatacctcagtcacctgccgcccggctgctcagcaggggtgtttgtgaggccctgggggtgccccggaaggggcaccccaccgcccctgttgggaaccagagcagaatctgtgggcttgtcgcctgccagtagtataagcaacactttctgttcaccaccattgtcccttgcattacttctttcttacagcatatttttaacataaagctgttagactttatatatttctaataggtcagacattgcctatttttcatacatctggtgctgcctttttgtaaaactaataatgacttggttgagcttgaaagaaaagatgtctgaggcgacatcaaaggggcagaatttttatatttcccatatggctttgggagagcgccgagaagccgccatcccgcacctcagcgctggccagtactctgggggctggcggggtggatccattgagggggtcggagggagcttggaagcagccggtttctttaaactcttaccaaaaccccgcgctctgtctagacggtgatgattattattcaagacctggaaacatttcgaggaagggccactataattgtccttttgtgtggcggtagaaggagcacgcaggtcaaccccagccgggaaggcaaaatcttccctttattgcctcagagagaactgcaattagcattctcagaagatgatttcttggtatcaaaatgtgcagtttctacaacagtttagatcaccaccaccatttttcttcttttttaaaaataaataactgctcccatttcaggcagtgcaaaccttcatctgctggagaccagaggtacaaggagatcagggggttgcagcaccgctgcaggcttgcaagatcggggagttgggagggcgagagaggaggaggtgcagctttgatgctgggacctccctgagtggggctgatgaatgtatattcattagcaccatggctcacttcccaggaagactgatcaggagcccttcagggacaattttgttctcaagattcacaccttaggaacacatttttatcacctcaaaattttgatccatcacccctctctccacctatatttttacaaataccattcagacttaaattaagctgaagaaactagcctttggtaacatagggtgtcattggttttcagggatgtaaccaattccagaaatacattcttttgcctggcatgaagactttgaaacacgggccgcttattttcagagttcctgttttgggacgtgacttggctacttgttacttccaggtggtcaccacacggcgggggtcatgcctttccctcccccaagatgataatagatttaatagactcaaagaagttgttcagaatcaaagaagaaaaagtctggcttaaacatagtaacttctgtgtgccaggttaatgacaaccaaaagctctctatttaccattattgccaaacttcatcagttgcccatcctgcaccaaaatcctgtgcgtgtttaaattcacgttgtcaccaaagaggtgcacagatcaacaacctggatgacgcaggtgttctccagggaaaccagaccaagtcaagtctccaggtaacttttttgaagtcttttttttaaggcgcgcaggtaccaagcaacagaatagagtaacctgaacgttcttactctcccaggcatggcccacgtggtgcttcaggtagaaatgtgcttcaccctcctggtggggggcgaggacacagcccactgcatgcagcatggtagagagctggggcgaatatctccatgtctttggaggatgtcagctggccgctttcagggcagagtcgggtgggcgttggtgccaccttaggaaggagagcgatgcgtgggtctggccagagctctggagccaatgccgggctgcctgagagcagaggaaatgcatggcccatgtgcatttctgagtattttaaactcgttcaggccctgcagccttcatgatgatgtagctcgcagagaagagcaggagcagaattagccctttcttcaggccatcttgcctcaaagggtacacatgtttggcggttaagatgaaactaacccttatgtttcatcctggccccatgatgtacacatcttagccatgtagtggccttggggggccacagagatttcctttgaggagcatggtagagtccacagccatggctgaagtcagtggacaccgaggggacaggactgcaggccaccaggggcctctgcccagagggaggcagagaggatggcggccacgggtgctctcctggcatcctcatggggtgatgccaggccgggcacttcaaaacaggctcagccgactgggagatcctttgtactttgcacagttcacacacacaaacacacacaccctatcccaagtgtttttgttagacacaaatgtcagcgtgtgattttggaagacttgtcagtgatgacaaaccatgatgcctgtgtttctgagtctttaaataaaaatgaacatggag

SEQ ID NO: 18979 - DNA, 4416 bp, Homo sapiens
  ENST00000504690
tgcattgtgcattgagcaggcctcggtccctcgtgtgccagggaggaggcgggaggagggacaccgttgggaggctgtcccttgcagcactcttctggcctgtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaagtttctcctctgttgcccaggctggagttcagtggtacagtcagggcttcctgcgacctcagactccggggctcaagtgatcctccagtgtcaacctcctgagtagctggaactacagggcagttgcaggctggcccagggcagacccaactgagggcaatggtccttagagctatggccaccctgacgtggatgcctggtgagaggcttgtgaacagagaagactaactgtggagatgctgacccatttagcttttacctgtcccaggatggttggagatctctgggagagagagagaggtaatgaggactcagttttgaccaaggcaagatggcttcaaaaaaataacaaatgccttggcaatgatttcttggacatgataccagaagcacaggcaacaaaagcaaaaacagatgagtaacactacatcaaactaaaaacttctgcacagcaaaggaaacaaccaacaaaatgagaaggcaacttacagaatggaagaaaatatttgagaaccatatatctggtaaaggcaaaagactcccaccggaagccaaccagatgtggctgcctaatcttggacttcccagtctccagaactgt

SEQ ID NO: 18980 - DNA, 316 bp, Homo sapiens
  ENST00000510350
tgcaggatatctctctcagtcttccaattcttaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaagggcagttgcaggctggcccagggcagacccaactgagggcaatggtccttagagctatggccaccctgacgtggatgcctggtga

SEQ ID NO: 18981 - DNA, 7324 bp, Homo sapiens
  ENST00000323829
gccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgacttggtgtgtttcttcaatatgaagattcatgtctttcttcaattctggaaaattttcagtccttcttcctttgaatattgcctctctctcgttctttttagtctctcttctggaattcctattagaggagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacatttacacacacattttgtctcatccacaatgggggcagatgagatggaggacttgatggatgggagagaataccaatacatgtcttttttttttttttttttttttgagacagtttctcctctgttgcccaggctggagttcagtggtacagtcagggcttcctgcgacctcagactccggggctcaagtgatcctccagtgtcaacctcctgagtagctggaactacaggcatgtgccatacccaactacaaggcatcttattgatttcagggcagctgctttacaaagcatctctattaataacatcactgcatagcacactgagtggcctaaaacacttataatctcatggtttctgaagggcaggaatccaagcatgacttagctgagcccaccagcttagggtggttcacaggctgcaatcagctggggctgcagttatctcaacttcaactagagaaggatgggcttccaagctcacccacacagctgttgttaggagtcagttttttgctagctgttggccagaggcttcctgcagccacttgccacgtgggcctctccacagggcagtcacaacatggcaccatgcttcactagagggagcaaacaagaggagcaagaaccagagtgagcaggagaaaagggagtgactctttctataacctgatcacagaagtgacatctccttagtcttgcctattcaattcataataaatgagtcactaggtctagctcccacaagaggggagtgtttaccaacagcttgaataccagatggtgaggaatcattggggatcatttcagaagtgacctaccacagtatctgagttctttgataatgaaattgggaattctctaatttcagcaaactgaaaatatggtccactaaccagcagcatcagcatcacctgtgagattgtttgaaatgaaaatctgtggccccacctatgatctctgaatcagaatctctggatcccagaacgctgactcgtccaagctttcctggtgattttaatgcaccctaaagtatgggaagcaccactgcagggcaagagccctcagatagtgtgcataactattacctggtgaggttgtggaacatgaacttcttggtttctatctctaataattctgattcagtagatctgggatgtatcccaggaacatgcatttttagaaagcaactcaagcaagcctgatgcaggtggttcacccttgctccttttctgtgaaccacaaggataccagccataattccctgcatctgatgcccatcagcttagcttttattatcagaccatctgcccttaatttctagcttcttgggctgaccagatgattggttgtatgaaagggtgagatgggagtggtgagttgagccgccattgcatcttctagtcatcaaggttgtctactaattggcacacattttctcttagagatgtggttggttgtcaaaaggctgtctactctagagagtattctccaggaaggagaagcttccagttgtctaattagtaaagttatctaatctactaccatggagaatagatgtggttttgcccccaccacaagctgtaaaagccccaagctgggagggacgttgcggttgaggctattcagtctaatctcccgtgcatagtcctttcaacaacattcctgggagacagtcaggggcacacacattccagaacagttacatatcgtgtatttgaagaaggctcacacagccctggaaaccatgccactggccattccccatctgactcaggttacagatcccctcccttttcccactgaccactcactctcctctggccagatttgtttctgtttctctgaaagagcagttcccacaactgcatgaggcttttgatattggccggtgggtgaagagtacagagggatgttactatacttaatttgattcttcctctccccagcagccacatctgtccttggcttccattgagctttataatcagttgaaacttctgtgtcttctgacttgaacttctgtttggacagatctttctcaattgctgcaaatatgcacatgcatttgcatatgcatacacatacacacacatacgtgaagagcgttgtttctatccatgttacatctccttggaaattttagctaaaatttcccaattctgtgcactttgatttacctataaatctgatgaatttacccataaccaggtcagttataaaaatgtttagcatgtttccaaagacaagggtaagactatttttttaaaataagaaaaacattgtgctatataattgcaattactacattctatatgtaaaccgcttgctaaaactcttttaaaaagtgtttaaaattttcatttttgaaatgtgggccagctattccctttggaaacatgttgatgctgtctttttttcatgatccacagagagtaaagtggtgattggatttggtctctacttaaacatttaaaaaaataagtgtatcatagccaaacatgatctagttaccctctttattctaattgttccctcaaatcttatatgggctgtgtgactgctggctccttacatctaatctaaataaagaacaagaagggcattgc

SEQ ID NO: 18982 - DNA, 712 bp, Homo sapiens
  ENST00000515229
tcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaagtttctcctctgttgcccaggctggagttcagtggtacagtcagggcttcctgcgacctcagactccggggctcaagtgatcctccagtgtcaacctcctgagtagctggaactacagcaaactgaaaatatggtccactaaccagcagcatcagcatcacctgtgagattgtttgaaatgaaaatctgtggccccacctatgatctctgaatcagaatctctggatcccagaacgctgactcgtccaagctttcctggtgattttaatgcaccctaaagtatgggaagcaccactgcagggcaagagccctcagatagtgtgcataactattacctggtgaggttgtggaacatgaacttcttggtttctatctc

SEQ ID NO: 18983 - DNA, 4153 bp, Homo sapiens
  ENST00000504517
tgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgacttggtgtgtttcttcaatatgaagattcatgtctttcttcaattctggaaaattttcagtccttcttcctttgaatattgcctctctctcgttctttttagtctctcttctggaattcctattagaggagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacatttacacac

SEQ ID NO: 18984 - DNA, 2681 bp, Homo sapiens
  ENST00000502274
attatccatgtaacagccatagcacaatcctgggtacatggtaagtccttggtaagtgttgcctgtgccacactattattatattacaggtgctgttgttccccaagtgtaaagtaaatgatattttattctcttcataagctatgttcccattgcaaaaggactgtgccctgaattttaaattagttaatttttagttaaaagtgcattttcccatgaagctaaaatgtaaatgaaggtcaggttcccattaccctaactcagaacatagctgaatatcttgtgtttatgtcaaaagctagtgggaaacaataatagtcatcagaacagataaatggcagaataaaaaagatttaaaaacccctcatcttgaatgttggtgtttgaagaaaagcaggtttgatagagaagccttgattagatgtaagggtaaatgtaatattctgtgatgattccaggagggtcttctgggcattttcaagggcatcgggtgtggatgataccggactttattttgtctaattgcattcttgagagagccttccctcttttccctacctttttccttattgcataggatctcatctgagtgactgtgtgctaatctcaggaaaggccttggaggccccaggcagttcctctgagcactctttatccctcactggatgggagctgaagggaggttgtatgcatcctttatataagtacttcccctgtggctgatttttccatatcagagaattttctctctcttagattttcttttttaattttggcttttggctctttgaagcttaaaagtgatgtttttagatggtatcccacagccaccttgcaaatattccaaagacatgattgtaagcctttgttccctgtaaaagattgctctgtattaaaacaaatccaccaaacaacaagtcatagacccgttagaaaccagcattctaaagcatggtttaagtgtgaacaggtgtttgtagcttatctgagactgacagtaggtaaaggggccaaggagagactgctacatggtggtacccaagataattctctgaagagagagacttttgtgtgaggaagacatttattatacagagtgatttattgcaattcttagctactccatcaagctagacttgtcaccatgtcccattaaaagggtttaagaagaattctttctcagaatcctgcattacagtagcatctgcaataaggagaaaattttcttctgggaatcactccaggaaaccttgacccatcctctacttagtcactcttatagagccctgcattttcttttgtagcatttatgacatgtgtaatgttacatttgtttgtgggattatttaaggaatgtctgtcatgtgagacaataagctttatgagtacaggcacctcttctgtcttatttcctatgccccagcacagtccctgacatctagtagaccttcaaaaagttttatggaatgaatgagtgaacaaatgatgcaaagtgttggttgcaggatatctctctcagtcttccaattcttaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgcaggccacagaaagatttgatggtgcagcgatgagaattcctggttccaggctttgcatctggagcctttaccggttgactgttgccttccacacaaacagcctctgaaaagcactttctccatacataattctggagaagatgagggatcttgccctccaggagccttccttcctcccccaatgaggaaatcagtcactgcactggtgcaaaggcaagcagattggaatttgtgctcttcaccgattttctcagggaaagaccccttccccttgccagcagaggaacctgtagttttttccatttctttcttcagaaccaaagtatgtatcactcctcatgctcacagggattgacaggagagaattcaccaggatcttagctcaaaagacacagcctcagaatggccagatggattgcacgaaacctgacttggattcaccatcttcctcctgccataaggctgtgctcccacataacctcccagaagctccagggaagctttccaagagcaaaggcttggaaattgaatgttaagaaaattatgacataaattacatgtaaatagtgtatatgattaaatattgtccagttacattt

SEQ ID NO: 18985 - DNA, 3077 bp, Homo sapiens
  ENST00000510779
ctgagtgttccagcttcctccacactcttgctcgcactgacatcacatctgtctaccggctcagtgggtttgaatccatccagaatcctccaaatgatctgagtggtgagtagcgatcatgctgaacctgacattcatccttgaggacagcacttctgtcctcttgccaagagcggccaccttaggtgcaggtgcccaaggttgctcaactttgcctgtccttacagcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagtccttacctggcctagccccctcatttcacaagaagaagaatgaagtccaggaggagaagggctcattgca

SEQ ID NO: 18986 - DNA, 4059 bp, Homo sapiens
  ENST00000515425
agggaggaggcgggaggagggacaccgttgggaggctgtcccttgcagcactcttctggcctgtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgagt

SEQ ID NO: 18987 - DNA, 4002 bp, Homo sapiens
  ENST00000512049
ctgtcccttgcagcactcttctggcctgtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtccctcaggaggtcactcacatgcatcaaggagagcctgcgtatcttcattgacctgggggagacagacaaggctgctgaggcctggcttggggcggggcgactccactacctcatgcaggaagacgagctggtggagctgtgcctgcaggcagccatccagacagccctgaagtcagaggagcctttgctggctctcaaactttatgaagaagcaggtgatgtgttcttcaatgggacccgccacaggcatcatgcagtggagtactaccgagctggagctgttcctttagcaaggaggttgaaggcggtgagaactgagctccggattttcaataagctgacagagctgcagattagcctcgaaggctatgagaaggctttggaatttgccaccctggccgccaggctcagcacagtcacaggagatcagaggcaagagctggtggcctttcaccgcctggctacagtgtactactccctgcacatgtatgagatggctgaggactgctacctgaagaccctgtccctctgtccaccatggctgcagagtcccaaggaggccctgtactatgccaaggtgtattatcgcctgggcagactcaccttctgccagctgaaggatgcccatgatgccactgagtacttccttctggccctggcagcagcggtcctgctgggtgatgaggagcttcaggacaccattaggagcaggctggacaacatctgccagagccccctgtggcacagcaggccctccgggtgctcctcagagagggcgcggtggctgagtggtggtggcctggccctctgaggaaagctgtcctgtctctggacatttggcatggccagactctgaccccactgccctaggctcttaaatactcattgggagggtccgag

SEQ ID NO: 18988 - DNA, 4051 bp, Homo sapiens
  ENST00000513604
tcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgacttggtgtgtttcttcaatatgaagattcatgtctttcttcaattctggaaaattttcagtccttcttcctttgaatattgcctctctctcgttctttttagtctctcttctggaattcctattagaggagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtaagtatgtcccatgctgctgggaagctatagagaaaagtgttggatcaagttttatccatttcctatctcaagtcatctcattcatgtccctgctttgtgttcaggtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtgagtcagggtcaggaactgtcctagaagcagctttccttccttaaggagaaacagtgttctttcccacaggaagcaagtccaaatgtacatggtataggcggggctttgtgcaaaagagcaagggctctgcagccaccacaatgcatccatcacttattagtggtgtagccttgggcaagctatttaatttctccatgtctcagtttcctcatcagccaaaggaagataataatggcatctatcttatagtgttattgtgaaggataaatgagttaatgctcataaaacactcataactgtgcctgatacatagataggtctcagtaatgccactgttacttgtgtgtttctataaccacctgtcacaggatcatgactgaggctgcataattcagagaagtggcagttataccaaggacagaagaaccttcaggaggtcttcattgccaagggcaactggttttaaagaaaggtcacccccactgaaagcaggggtgtaaaatgtcatggtaaaaaaaagttttatcgggaacttacctttaaaatgaaattgtagattatgaaatgaagtgtgttttcaccttttagttaagaatatttagattacaatttcaactttgcattaagtcttagaataaacatggaataaaaggagtgttgactttttggcttaattgtgctgacaaaatgatgtaacagcacaatggagcattctttgttttgtgattgattttttaggactaccttaaaaatcctcatttttgtaaaaataaatcaaaacttaacagttt

SEQ ID NO: 18989 - DNA, 3276 bp, Homo sapiens
  ENST00000511307
gtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggtattataaaaaaaccaggccgggtgcggtggctcacgcctgtaatcccagcactttgggaggccaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtcagcggggcctggtactggtgtcagccttggagcctctgcctctccctttccaccagtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgacccggaactgctcatggacctaagcactggtcaggaggaggaggctgagaacttcgcccccatattggcttttctggatcatgagggttatgctgaccactttaagagtctctatgacttctccttctctttcctcacttcttccttttatagcttctctgaggaggatgagtttgtggcctacctggaggcatcaagaaagtgggccaagaagagccacatgacctgggcccatgcccgtctctgcttcctcctgggccggctgagcatcaggaaggtcaaactctctcaggccagggtgtacttcgaggaggccatccacattctcaatggagcatttgaggacctatccttggtggccactctgtacatcaatttggctgccatctacctgaaacagaggctgagacataaaggctccgccctgttggaaaaggcaggtgccctgctggcctgcctgcctgaccgtgagtctagtgccaagcatgaactcgacgtggtggcctacgtgctgcgccaggggattgtggtgggcagcagcccgctggaggccagggcctgctttctggccatccgcttgctcctgagcctaggccggcacgaggaggtcctgccctttgccgagcgcctgcagctcctctctggacaccctcctgcctctgaggctgtggccagtgttttgagttttctgtatgacaagaaatatcttccacaccttgcagtggcctctgtccagcaacatggtatccagagtgcccaagggatgtctcttcctatttggcaggtccaccttgtcctccagaacacaaccaagctccttggctttccttccccaggctggggtgaagtttctgccttggcctgcccaatgctcagacaggccctggctgcctgtgaggaactagcagaccggagcacccagagggccctgtgtctcatcctttccaaagtgtacctcgagcacaggtctcctgacggtgccatccactacctgagccaggccttggtgctagggcagctgctgggtgagcaggaatcctttgagtcttctctctgcctggcatgggcctatctcttagccagccaggccaagaaggctttggatgtgcttgagccactgctatgctccctgaaggagacagagagtctcactcaaaggggagtcatctataacctcctgggacttgcactccaaggtgaaggccgggtgaacagggcagccaagagctatcttcgggccttgaacagagcccaggaggtgggagatgtgcataaccaggcagtggctatggccaatcttggccacctgagccttaagtcctgggctcagcatccagccagaaactatctcctgcaggctgtacgactctattgtgaacttcaggccagtaaggagacagacatggaattagtacaggtgtttctctggttggcccaagttctggtgtctggacaccagctgacccatggccttctttgttatgaaatggcattgctgtttggcttaaggcatcgacatctaaagagtaagtatgtcccatgctgctgggaagctatagagaaaagtgttggatcaagttttatccatttcctatctcaagtcatctcattcatgtccctgctttgtgttcaggtcagcttcaggccaccaaatccctctgccatttctacagctctgtgtccccaaaccctgaggcatgcatcacctaccatgagcactggctggccctggctcagcaactcagggaccgggagatggaagggaggctgctggagtccctggggcagctttatcggaacctaaataccgccaggtgagtca

SEQ ID NO: 18990 - DNA, 721 bp, Homo sapiens
  ENST00000513340
gtgtgtatgatccacaggcacttgttcttattgttgtttgtgtcattgccgttgttgtgggtggtgatcttgagaggcagttttaataggatattggggacagatgtcattttcataacttatatttggacttctgcacctcacgctaatttacctcaaatgacacactctccagatatcagagctccttgaatcacagcaacagagggatgggttttgagctcagaggaatgacccaactccacgcaagcaagccgctgaagtctctgcacgctgccgtccgactggccactgggtgtcactcttgtctatgtttgctgggtgtcagggtctgagaagaaattcagcctttgctgaagtctccatcttctccgtgagcaggaactctgcctttctcagtgatgaggagagatgctccctgttggccctgggaagtgataagcagactgagtgttccagcttcctccacactcttgctcgcactgacatcacatctgtctaccggctcagtgggtttgaatccatccagaatcctccaaatgatctgagtgcatcccagcctgaaggtttcaaggaggtcaggcctggcagagcctgggaggagcatcaggccgtggggtccagacagtccagcagctctgaggactccagcctggaggaggagctcctctcggccacctcagacagctatcgcctgccggagcctgatgaccttgatgac

SEQ ID NO: 18991 - DNA, 570 bp, Homo sapiens
  ENST00000503071
ctgtagatgataaacacctggaaacaatatacctgggactcctgatacaggaaggccacttcttctgcagagccctgtgctccgtgactccaccagccgagaaggaaggggaatgcttgacactttgcaagaatgagttaatctcagtgaagatggcagaagctggctccgagttggaaggcgtgtctttggtgacaggtggttcctaaagaattatccaggaagctgtggcctttccaggaagagggattggacaggctcctatcagattggcagaggacgctgtaaggccttgacgggttatgagccaggagaaaaggatgaactgaatttctaccagggagaaagcattgagatcatcggctttgtcatacctgggcttcagtggttcattggaaagtcgacaagttcaggacaagtgggctttgtccccaccaggaacatagatcctgattcttattccccaatgagcaggaactctgcctttctcagtgatgaggagagatgctccctgttggccctgggaagtgataagcagactgagtgttccagcttcctccacactcttgc

SEQ ID NO: 18992 - DNA, 573 bp, Homo sapiens
  ENST00000511949
gtgttcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagcctgatccttctctctctgttctctttaagacctgacactctccttctgtgtaaagagccgctccaggaggtgtgtaaatggacccctacaggaagctgctcggaggcggctctgggcactggagaatgaggaccaggaggtgcgcatgctgtttaaggacctctcagcaaggttggtcagtatccagtctcagagggcccagtttctcatcaccttcaagaccatggaggaaatctggaagttctccacctaccttaatttaggctacgtatccatgtgtctagaacatctcctctttgaccacaagtactggctcaactgcatattggtggaggatacagagatccaagtgtctgtagatgataaacacctggaaacaat

SEQ ID NO: 18993 - DNA, 4522 bp, Homo sapiens
  ENST00000504091
tcccaagggcctcggccagggtaggatggtacacacatgggtggctgcttctgcatccccagggagcggagtctgacccggggcccaggtaaagaaactccttccaaggatccaactgtatcgagtgagtgtatagcctcatctgaatacaaggaaaaatgttttctgccacagaacattaatccagacctgacactctccttctgtgtaaagagccgctccaggaggtgtgtaaatggacccctacaggaagctgctcggaggcggctctgggcactggagaatgaggaccaggaggtgcgcatgctgtttaaggtgagcatgaaggaaacaggtgaatgctgagtactgacttgtgtcagtctgctacaggatccctagcatctaagacagcatctggaacaaagtaggtcctcggaaaaaacatctaataggtagactgaatgaatgaaagattccgtgcacattctctgcacaggagtggagaggagtgggcaggaactctgaatgaggcaacttggagttgctgagtcagagaaaatttggtttcaaatattctattagttgtgatctttgacaagttacttaacctatatagaatgggagttgttataatacctacctcattaagtatactttttttctaatgcggtaatttcaaattctttttttttactgtgatacaatatacataacataaaattttccattttaatcattttttaagtgtatgattctctatgacactaagtacattcacaacctatccacctccagaactttttcatcatctcaaactgaaattccatatctattaaacaataactcccattatccccatgtctcagctcctggtaaccgctaagtatatatttttaaagtaccaagattgccaatcaaaaaacaataccttataaatacttgggtgagaggaggaaaaaaacaataaagtaaataaaccaatttctcatctttcatagtaggtagataatatcttcatttgttaaaaccaaggaagaatggtatgatcaaattatttacagtttaggatgtattaagtaggagaactaaagtcagaaatggaaaaaagttgtttcaactagaggtagggaaaggataatattactttacataaactaatatgttctagttactttttacagtttctgcatgaatctggtacaaactgaaggagaaaagtgttctaaatgtcatgcagcaaaaaaagataatgtctggtttttcagggggaaaacgagattgtatgagtagagagcttggcattgtgtttggtgatatgtgttccataaacagtagctacatttttttgaattttattttattttttttaatatctggaattcaggaactgggagacactggctgctattggtactgtagattttcctttattttgagtctcatttggtatggcaggagcagggttgattgagagagctggtctgctgggctgaagcttgagtcagacatacttgtgggctacagttgaggcctggagtcagctagatctgaaatctaatcaaggctccgcagcttactccctgaaggtgaccttggacaatttacttaacctctctgtgccttggcccccttgaatatgcaacagggataatgccatttttcattagatctaagatgccattgattataaaatgcactgttattttatgtacttccaagaaagaaaacaaatgctgccaattatggttgatgacatacttccttatcttttagttcagaagtggttaaatgtgataaaagcacattttggaatggcccaaatactgtcattgcattctcttcatagcgcttttgtgggagttaaatgacatattgctcataaagctctgggtgaagtgccagggatgtagtaaattctctgtaagttgatttttacctagcaccccttccctaatgatggatctggggcctcctggggtttggtatggcagaaggaaccccagagttctgattttactgaactggggcttttcttctggattcttctatcttcttcttcctctaagtttccctcatgatagagctcctggagttggtactgatgacaggacctggcctggtggagggatgttctgaccgtcacttgttacagtcaactccggaggcttggacaaacaacagatttaagggaaaactaagtctgggcagtgattcagacctgctttttttttaggtattataaaaaaaccaggccgggtgcggtggctcacgcctgtaatcccagcactttgggaggccaaggtgggtggatcatgaggtcaagagatcgagaccatcctggccaacatggtgaaaccccatctctactaaaatacaaaaaattagccaagcgtggtggcaggtgcctgtagtcccagctactcgagaggctgaggcaggggaatcgcttgaacctgggaggcggaggttgcagtgagccgagattgcgccactgcactgcactccagcctggcgacagagcgagactccgtctaaaaaaacaaaacaaaagaaaacaaaaaaacccccaagaggcttatagtcttcctgtcactctccttgtgagcatgtaaattggaaagccttcctgggggacagttgggtgactgcattttaggattgaaaatgtgcatatccttgcatttccaattgcacctcttagaaatacatgtgttaaaacaattaagaatgtgcacaaagatttagctataaagatgtttatcacagtaccatttaggattttaaaaaatgtaaaacaatccaaacatgaaaccataagaaaatgataataattcattatgttaatgcaacaatggcacatgtaaccattaagaatggtgtaaactttgtgatgacatagaagatgctttgcaaaatattgcttagcagcaaaagaagattgcaaaataatttatgcaatgtgattctatatatgtgaaatagttatatggaaacttgtgtaggaaaaaagatgcaaatttattacatgaagatgttaacactgatgatctttaggagtagggactagggatgattatttttgtgtgttttggtttttctgttttcagctttgtattaataaaaataatcattagacatagactcataatcaaatttgctttcaagatgccttctatgaatcagcgtcctttatcctcccacatacacttttttttttaaacacaaaaagtagcattctttgcccatagttctattccctggcttcttttgctgctgccgctgtatagcagtattatatctggagcctatatcagtacacaaagagcttctttcttcttttctgtggctgcataatacaatatttcactttatggataaattgtactccattttaaccaatctcttattgatgaatatttaagttgtttccattttttggtgacgtaaaaatcaatgccataatcaagaagttcatacagagtatttggtctatataagagcttgctaatgggacacttctgtcatcccaggctgactcattgtttcctttacgtaggacctctcagcaaggttggtcagtatccagtctcagagggcccagtttctcatcaccttcaagaccatggaggaaatctggaagttctccacctaccttaatttaggtatggtacaaggcaagcaggtggaggatgacctcctccacaatttagccaatttgtagggcttgacatgaaggaattggcctggctctggtaattaagagaaatagagccttaaaaaagatggttaacttttgaaatttcacaaagtgcctcaaactaaatctaaggcaaatattaactattattctaaaatgccgtatgaagaagtttgcttttttgtgtccagggagatctttttttattagataaccaatcaattggaaaacagttattggtcatctactaagttcaaagtactgaaatagatgtgaacttggtgctagtgtgtgtgttttaaactatagggaactaatcttgagtaagatcgaagtagctgctcaacatagtcaatagcaaagttccagatgttttattgcatgtatttggaaaagagttaaagaaagaaatagagaaattatctgcttatagcaacctaaggctgcagcgttttctagaaggtaaagaaggacattgggatgcagcgtcagttccactgtggtgggaaatggttcacctgccttctccagacagaacaacttataatggggaagttaaagtgaagccaaacaaaacaacaggccacctaatttgatggatgttttatatctcccagaaaatgctgggctccatgccgacatacacaaggacagattttgtgcaggggtggagggtcaagatgactcatgactggaaaacataaggtgtatcttctcctcttatggtctggagatctgatctccacactacacatctccttcctgaccatcagacatcctcactattcaaactgtgctccatagaccggctcgttggcagcacatagagtctgttaaaaaaaa

SEQ ID NO: 18994 - DNA, 4785 bp, Homo sapiens
  ENST00000391813
atgcaattaatggccctggagcagaggtttgggtctgggttgccgggtgggggacagcctctgtgtctcatgatgtcttctccactccccccaccacccccccatttctcctgcctccctgccagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatctcccaaggcc

SEQ ID NO: 18995 - DNA, 6643 bp, Homo sapiens
  ENST00000293441
gtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcttaatggatgggattggcccagggagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatctcccaaggcc

SEQ ID NO: 18996 - DNA, 6622 bp, Homo sapiens
  ENST00000391814
ggccgcgggcgccgccgaccgggactcagcagccccgccaggcagccgcctgtgatgctgccgtcccccgtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcttaatggatgggattggcccagggagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggtctccccctggaagaagaagagtgagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccc

SEQ ID NO: 18997 - DNA, 6459 bp, Homo sapiens
  ENST00000359082
atgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtga

SEQ ID NO: 18998 - DNA, 422 bp, Homo sapiens
  ENST00000483981
tatagaatagtggtgaagagctcagactttggtgccatataaccgggctctgccacttcctgtgtgtccttagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctcccca

SEQ ID NO: 18999 - DNA, 668 bp, Homo sapiens
  ENST00000468654
cccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagtatagaatagtggtgaagagctcagactttggtgccatataaccgggctctgccacttcctgtgtgtccttagactctccgacgactcccagtcctcactcctctccaagcctgtcagcagcctgt

SEQ ID NO: 19000 - DNA, 558 bp, Homo sapiens
  ENST00000461154
tgccaggatcctcctgtatcgaggtgccgacaaggatgtgaagaacaacaacggacagacccccttccaggtggcagtgattgctgggaattttgagctgggggagctgatccgaaaccaccgagaacaggatgtgggtgagtgacagggagctcggactgcacagagaacctggggcggttgaggtttcatggtgggatgggggagttgggggacctgacttgggggccaggataggatggagaaaaccctagaggaccaaaaatgtctggatggtggtgggggagcaattccaggcccccctccctttctcatctctgtctttctccctcatgcctctctcccaccatctcttgcccccgcatggccccctgcttgccttttctcccctaacatctgccccccgccgccactgtgccctctcagtgcccttccaggagtcccccaagtacgcggcccggcgacgggggcccccaggcacagggctgacggtgcccccggcgctgctgcgggccaacagtgacaccagcatggcgctgcccgactggatggtgttct

SEQ ID NO: 19001 - DNA, 780 bp, Homo sapiens
  ENST00000483128
gacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggtctgcctagcagcggccaccccaggcccctcacatccccgatagccgcctcccccagggccaagctcagacactcctcttgactgcatctctgcaccctccacttcttcactatttccaccctttcatccagtcattcctccattcattcctccatccatccatccatccatccatccatccatccaacagatatttactgagctcctctgtatcaggcctggagctgggtgctggggacaaagtgttgagctcatggcctagcagagggcagacaacatagtttgctgctacagtccagagtgctcagagcaaagtcacagggaatccagatccctgcggga

SEQ ID NO: 19002 - DNA, 1879 bp, Homo sapiens
  ENST00000608988
cttccccaccccctgcacctgagccgcggcggcggctcctgagctccggcggggctgggcgcggcgccgctcgggttcccgcggccgatccaggtgtgcgcggacgctggcgctcccggggggctcggacccgcccccgactcgccgagccaggatatttttgttggtataaaattatggattgagaatacttttctttcatcacttgaaaattactgtgccactttcttttggtctccacagtttctgatgagaaatgtctggaaatctctccaggcaccctgctttggccctctagaatacagacagttcctgctctaagaggccatctgtgaggctcagtctcccaacacctctgacacaggcagccatgccgcgcagcccaacatccagcgaggacgagatggcccagagcttctccgactactccgtggggtcggagtcagacagctccaaagaagagaccatctatgacacgatccgggccactgcggagaagccgggcggtgccaggacggaggagagccagggcaacacgctggtgatccgcgtggtcatccatgacctgcagcagacgaaatgcattcgatttaacccggatgccacagtgtgggttgcaaagcagcggatcctgtgtacattaacccagagtttgaaagatgtcctgaactacggcctgttccagccggccagcaatgggcgtgacgggcgttccttccctggagtttcgatacaagaagcgggtgtataaacaagccagtctcgatgagaaacagttggccaagctccacacgaagaccaatctgaagaaatgcatggatcacattcagcatcgcttggtggagaagatcaccaagatgctggaccgaggcctggatcccaatttccacgacccggagaccggagagacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcagatggactctcactctgttgcgcagagtgcaatggcacgatcccggctcactgcaacctccacttcccgggttcaagcgattctcctgcctcagcctcccaagtagctgggattacaggttcgtgccaccatgcctggctagtttttgtatttttggtggagatgggttttgctatgttggccagactggtctcgaactcttgaccttaagtgatctgcctgcctctacctccgaaattgttgggattacaggcatgagccttcatgtctgacccagtctattaagttttatcatgaatctatgttgtcatatccgatgtgtcttgataaaatatttatccaaaatccgatcctgcaactgtcaaagatgattatgtagatttcccctgcttatctgctaatgcgatgaattatatttgtcaattttcttatttctaaaataaactcacctagccatga

SEQ ID NO: 19003 - DNA, 434 bp, Homo sapiens
  ENST00000618363
acgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcaggtggccataatagcaggcaactttgagctggcagaatacatcaagaaccacaaggaaacagacattggtgagtaggcacgtggagaaactgtgttgggatttggtttggagatgctctgaggaatcagtcactcaccagctttttaaaattctcctaagattggtttagagcctgcttttagc

SEQ ID NO: 19004 - DNA, 557 bp, Homo sapiens
  ENST00000425049
attctataaactgcagggcccaagctgcaggtttcaccttcctgagggtcgccacccgggaggcagaggcaccaggatggacgtgggaactacctccgctcttcctttctcacagtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaacc

SEQ ID NO: 19005 - DNA, 510 bp, Homo sapiens
  ENST00000498519
cactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccaggtggaatggctgtgaaggaagggggcaggcgagccaccaggtagccagatcttctaagcacagcaggtttgagttcgtctgatgtgtggaaagagccctgcatctttgacaatgtgactggcacaggcacgtggttggatttttctgcagaaaccacacctgtgtgtcaccagctgtgggga

SEQ ID NO: 19006 - DNA, 2775 bp, Homo sapiens
  ENST00000468619
agccgggtttgagagcagcccgtctacgtgcagttggttcccagctgacagacagaatatggggtgggctttgtcaccagcacgctgggtctggcatgcccagctatgctcggaagtgcaccgtgcccagacacccgccacctctccccgggtcccagctgctctagcaccgaggggccgggctgcacgcctgtccttcctcccatccaggaaggttatataatgagcggaccgctgccaaagtcagagggaaaatgaagtctttgttaaatgccttcaccaagaaggaagtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccaggttgcagacacatttgggggtccctgcaaccctcggagacagctggagtctggacctgtagggcctggttgtggaaacagccccgctgcctcctgcccggtggctctggaggccccttccgcacatccagggcgggtcggctgctccagttctgccttcccacccagtgctgggatgtgcaacgccccccaccgaatgctcagatgtgcagccccctcctctgctggcctggaccttggacctcacacgtgcacatgttctgacatcagtgcctcatccgatgtccaaccccggccagaggaaccaccgtcgcttcagccccactctgaccttggaagccccaccctgcatggaggcagaggtgggaactctgtcatccaccgttccccacagaccactcacagccgctttaagagaacagccagggcttctaggcaggagcacgacagtgttcacgctgatggccagggagcctcctcagccagcagcagccgactcgtgcttgtgcattgttcagatggaagcatgatcattggatggaagttcctggcacaggtgcaagttgaccctgagtcattccagaaggattcgggcctcaccggaaagaacgccaggaaaagccatagggcaacagctcttctgccatttcagtcctcatgggtgaaactggggtaaagcgtgagtggctggggccctgctgacacctgcacttgtgcgtcaccgccaagctgtgtccctagactgccctgggtgagtaggcagccaacgtctgcagccccgtgtggtcagctgctcctgccctcccgcctcatcacggcccttcagacatcagggccggctgcctaccttccaaccccactctgtctggaatgttcttttctcttctgtcccctccccagtcctccaacccattctcctatgtatacttcagtcctcctcctccaggaagtcttccaggtgcccgtatggttctcacagaaccacgtcctgcactgttgaaggcacacatttctgtgactgtggattgatgtttatcttcctcacttgcccggcctttgctctaacgatcaccacagactagggggctcaaaacaagagaagtcacttacctgtcacagccctggaggccagaggtccaaaaccaagatgacagcagggccacgctccctccgggggctccaggggagagtcttcctcctccacctctgctgttggcctgcagtccttggtgctcctcagctgggccacatcactccagcctccacatcactccagcctctgcctccaccttcccatggcctcctctgcactgcctctgggtgtcaacctccctctgcttttctcgcgtaagggcacagtcattggtttaggaccctccctaaatccaggaagatctcaactcaagacccttaactaattatacctgcaaagacccaaattccaagtgtcgtcactttcacagacgctgggggttaggaattggacacatttttttgggtgggttgagtcaccattcaactgaccacaccagacaactctataaggaccagactgggcctggtttgttccttcctaaatgcccagcacccagttcatcccctgactctcagtgggtattcaggatgtaacagctggattgatttattgatttacacggcggcttgacactggccccagttacttctgaactttgaaacccagtcccagctggtcacggaagaactaaagctgtcaccagacggggccaccaacccagctgggatcctgagagctatgagtaaagccatctggtctaccccaataac

SEQ ID NO: 19007 - DNA, 762 bp, Homo sapiens
  ENST00000470759
ttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgagatgtttgtctcagatttcctagaatcgaagtattcatattttgaaaagtatccatttcatacataggaaactgtgtcttagaagaaagttatctcacagaggagacaaatgttcagcccccttggcacagatagtgctgtttgctgtcagaggaaaaagccttcctgggcattaattaatttcccggggccattccttacccgcctgctgcagggctctgatgacgcctatggtttttgtgattgttttcttggccctgaagtggccaatctcatttttgtgttaatttct

SEQ ID NO: 19008 - DNA, 2123 bp, Homo sapiens
  ENST00000409530
ctcctcctgcaccctcgctgcctcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcccaccccagcaaggccctgccagcccacccaccagagggtgggaacctggccttgcccactagggagccattggaacatctgagtggcatgaaactcatcccccctgaaggacacaaaatctagggtggcttctgtcatcttgaagcccagttatctgtgataattccagcagggtaaagcgggagggtgggcggggtggtgcgagccaacccccctcccccaccctgccctgctcagggtgggaagggtaagtgggttccctgcattccccagccaccaccaggcctggagtatgagctcagcagatgtacttccaagggtggttgggtcaggtctcgaaatgaaataatgtactgtgtgttgcagaaaactgccttcctttcttcttaatgtcacaattattcctattgaccctgttgcaggcaaaggtacacttgaccttgagacaaggtcacacttgaccctttgagacagtccctttgtgagataattcagcattgcctttactgtgtcaattctggtagaagctaaggcccttgccctgtgagagttgtggaggcaaccctgggactctggtctgcccagcccaccccaggggcactgtcctgtgtgttctggaaatgcctctgggctgctgtgcaaaagcgcagcgtgcttgtgagtctcaggtggataactgtaggcagtcactaggcagtaagtggccgtggaggtggtgtctgctgtgcttaaagctccccctgcaccagcaaactcagggaaagctgcgtatttgtcttgcggttactggttaataacaactgatttcctcctgtcagacagcagaatctttctatcaggttagtgaaccttacggtttggaatctgtaatctgaatgtaacccagtttactttataaggtgtattcttaaattagtactccttgggaacagaattgccagacagccaactcagagtgactggtcaatggagaacactttgaacgagccatctttgcaatgccaaaatgtcctcccacaaggagtatgttaaatttggaatacccttatcgaatggaagttttcattggaataaattattgtagtttgtcctaggactttttttcatttcaagtaatttattttgctacctctttgaaaacctgcatgctccca

SEQ ID NO: 19009 - DNA, 1376 bp, Homo sapiens
  ENST00000412252
gatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgg

SEQ ID NO: 19010 - DNA, 5738 bp, Homo sapiens
  ENST00000606715
tgggaagtgctgctctaactggtcagccattgagctccaaagacagccccagtgcaagtcgatgaactggcccccagcagacgggcaggggcttcagtcttgccctccagggagtctccccacacggcagcatctctactgtttgcagctctccccctcttgcccatgaccctttcactgagacactgcagcccaccaccattcacggtcacgatgtcacaccagtgcactcctcatgctctccagagcccctccacccagggtaacccaccacataggagggagaggagcccacttcatgtgggaagatgtggagacaggagaaaagtgcacccaagctggcatctgacagagccagggctccagcagacatctctcaagtccaggtcttgaagagagagccgtggtaggatggatcttttcagaagcggtgggtgggccgttcatatccacgtgaatgggcccaaaaggcaagagacccacacctctcctcccctccccagtggctgtggctttcctagggacaataggatgaatgggctttcagtgtggggacagcaaaacatgcactagggcccagagtggcagttctcttggtgtggagagtgcctgccacaggccttggccagagcccgtgagggagtggtgtgtgaaaggccacctccacgtgggtaagcgtgaggacttggacttctctggcactgagatgggacctcctgcctgtgggagtcatctggccaccaccctggggccagtaaaggttggagctagaagggtcgtcctccctgacttgagctctgagggctttgcctgcccagccagagcggcaaggcacaggggaccctcggggacgcccatggccaccctggggaagacagggctcctcacgcgttctgcttttcagtaaggcccgtgtgtcctaccagtgagcctctcacatgaaaggggctaaaaataacacagggtaccccagctccttctgcaacaaaactgtccactgggtgggcgctggacagtgctgcctcaggaaggtgagcgcagcccacactggccacacaagccacgccctgctgtctgggtttccgggtgatctcaacccctgagtgccctgcgtagctacaggggttccagttactgaaaggggccacctgggaaggatcctgccctgctcttgtccatttacccaaaaagcctaaggctgccaggcggctgaggggcctgtcctccaggtgtgctccttcccacctgctgaagctgaggcgctggagatgttgcctggcacgttctacccaggtgacaggaccccactctgtccctgtctccgtgccctcttcaagggaccccttccaaatgcctcagtggccaccctcccgagggtcccccggccctgccccccagcacaggcaggtcccccagcccctctgtcccagttcaggtgagtgggctgacgtggtgtgctccccccagcacaggcaggtcccccagcccctctgtcccagttcaggtgagtgggctgacgtggtgtgctctggtgtctccaactttgctctggcccctttctccccctcccccaccctggcatggcaaatcattcgttcactgccagtggatctgccactagacactctggcatggtttgggcgtctccctcgccttcctgggtgatctgcagccagctgccctgactcggtgacctgccttgtgatggttttctctgtgttgctgtttcagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaa

SEQ ID NO: 19011 - DNA, 8850 bp, Homo sapiens
  ENST00000449833
tcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcggtttgcaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgaacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattga

SEQ ID NO: 19012 - DNA, 1373 bp, Homo sapiens
  ENST00000357171
gatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtgcaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgg

SEQ ID NO: 19013 - DNA, 381 bp, Homo sapiens
  ENST00000482659
agaaagctgctcccagttccggttcatcgaccactcagctttccattttctgaatggacctccgtggctcaagcaatcctctcacctcagcctcccaaggagttgggaccacagacacacagactacaggtctggaaatctctccaggcaccctgctttggccctctagaatacagacagttcctgctctaagaggccatctgtgaggctcagtctcccaacacctctggatcacactctgttgcccaagctgagagcagtggtgcagtcacagctcactgcagccttgacttcctagactcaagcaattctcctgcctcagcctcccaatagctggaaccacaggcatgtgccactacactcagctaatttttgattttt

SEQ ID NO: 19014 - DNA, 635 bp, Homo sapiens
  ENST00000458632
agacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcagccacagaaagcagctaccagagaccataggtgggtgtcagttcccacacttctgctgctcaggcccccccggacacacgaagccagggccgccctgccatctgcgtcccccagagtgctg

SEQ ID NO: 19015 - DNA, 736 bp, Homo sapiens
  ENST00000460048
ctttgaaatggggctaatcactgcagttaagggagtgtccagaagtttgcatagcatcacatataggtggccataatagcaggcaactttgagctggcagaatacatcaagaaccacaaggaaacagacattgtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcag

SEQ ID NO: 19016 - DNA, 522 bp, Homo sapiens
  ENST00000445654
cagccctacagtacctggagtccgtggatgaaggtggggtggcgtggcaagccggactaaggaccggggacttcttgattgaggctgtggatcaccggaagtcactcagcctctaaggtgaatacccacaagtacacccacatcctccagccccttggcactccctctcatggagccagctgggctgcagtgatcctggagggtgaccctgtctgaagctgcagcccacacacaccactggaggccgcagctgtggaggcagacccgggcctgcagcagagcaggatcaatgtcacccatatcttgtcaattgtgactgcaaacttcagaaggactcagagtggaaagtcttggcaaccatgttgcggttcagacagtgggagccatgcttctgcgaatgagcctggggactggggactgtggtcccagccctggatttgatgaggggagtatccctgtcctgcgagggtgcagtgtcacttttccactcccatttggggtcaactcttaacagcatccctg

SEQ ID NO: 19017 - DNA, 460 bp, Homo sapiens
  ENST00000426687
gtacagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagataaacccgaggagatagtcccggcctccaagcc

SEQ ID NO: 19018 - DNA, 939 bp, Homo sapiens
  ENST00000449116
ctcctcctgcaccctcgctgcctcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaataggtaagaagtgtggcactcccccacagaagttgcccctgggctttcaaacacagccttaggcccctcaggaattctgagccctgggcctctcacagttgccttggcgtcc

SEQ ID NO: 19019 - DNA, 9062 bp, Homo sapiens
  ENST00000601538
ctctagaatacagacagttcctgctctaagaggccatctgtgaggctcagtctcccaacacctctgacacaggcagccatgccgcgcagcccaacatccagcgaggacgagatggcccagagcttctccgactactccgtggggtcggagtcagacagctccaaagaagagaccatctatgacacgatccgggccactgcggagaagccgggcggtgccaggacggaggagagccagggcaacacgctggtgatccgcgtggtcatccatgacctgcagcagacgaaatgcattcgatttaacccggatgccacagtgtgggttgcaaagcagcggatcctgtgtacattaacccagagtttgaaagatgtcctgaactacggcctgttccagccggccagcaatgggcgtgacggcaagttcctggatgaggagcggctcctgcgcgagtacccacagcccgtgggtgagggcgttccttccctggagtttcgatacaagaagcgggtgtataaacaagccagtctcgatgagaaacagttggccaagctccacacgaagaccaatctgaagaaatgcatggatcacattcagcatcgcttggtggagaagatcaccaagatgctggaccgaggcctggatcccaatttccacgacccggagaccggagagacccccctgaccttagccgctcagctggacgactctgtggaggtcatcaaagctctcaaaaatggtggagctcacctggacttccgtgccaaagatgggatgaccgccctacacaaagctgcccgagcgaggaaccaagttgccctgaagacccttttagagcttggtgcatccccagattataaagacagttacggcctcaccccgctgtatcacacagccatcgtcggaggtgatccctactgctgcgagcttctcctgcacgaacacgccactgtgtgctgcaaagatgagaacggctggcacgagatccaccaggcctgcaggtacgggcacgtgcagcacctggagcacctgctgttctacggggcagacatgagtgcccagaatgcctcggggaacacggccttgcacatctgcgccctctacaaccaggacagctgtgcaagagtgcttctgtttcgaggcggaaataaggagttaaaaaactacaacagccagactccatttcaggtggccataatagcaggcaactttgagctggcagaatacatcaagaaccacaaggaaacagacattgtgcccttccgagaggccccggcgtactccaaccgccggcggcggccccccaacacgctggccgccccccgggtcctgctgcgctccaacagtgacaacaacctcaatgccagcgctcccgactgggccgtctgctccacggccacctcgcaccgcagcctgtcaccccagctgctgcagcagatgcccagcaagcccgagggggccgcgaagaccattgggagctacgtgcccgggccccgcagccggtccccatcgctcaacaggctgggcggcgcaggcgaggacggcaagaggccgcagcctctctggcatgtcgggtcgccttttgctcttggtgccaacaaggactcactctcggccttcgagtacccggggcccaagcggaagctctacagtgccgtgcccgggaggctcttcgtcgctgtcaagccataccaaccccaagtggacggcgagatcccccttcaccgcggtgacagggtcaaagttctgagcatcggtgaagggggcttctgggaaggcagcgcccgcggccacatcggatggtttccggcggagtgcgtggaggaggtccagtgtaagcccagggacagccaggcagaaacccgcgctgaccgcagcaagaagcttttcaggcactacaccgtgggctcctatgacagcttcgacacttccagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcact

SEQ ID NO: 19020 - DNA, 7271 bp, Homo sapiens
  ENST00000338508
tcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagcctcggtccggaagaagaaggataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcact

SEQ ID NO: 19021 - DNA, 6821 bp, Homo sapiens
  ENST00000424924
ctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcact

SEQ ID NO: 19022 - DNA, 9208 bp, Homo sapiens
  ENST00000409161
ttaaacccccttcaaggaaaagcaaaacaaaactgctgcctcatttctcctctggctgattttcccgggcttccctggaagatgcgtgtggtcgggacaagccggaggagctcattcccgacgccgccgctgctgaggccgccgctgccgccgccgccgttcgggccacttactttctttgccctgggcggcgtcctggccagccccccttgagcctccagctcagccatccctcaggcagccgccccaccatgtatgactccttcctccggctggctccggctctgcctgcccccaccctgcaagtctcattgtgccacgctcgcctatcccggtagccacccccctcttccttcgctcctcctgcaccctcgctgcctcctttcctccatgctgcctggatctggcgagctggggtgattaattggctatgatgatgaacgtccccggcggaggagcggccgcggtgatgatgacgggctacaataatggtcgctgtccccggaattctctctacagtgactgcattattgaggagaagacggtggtcctgcagaaaaaagacaatgagggctttggattcgtgcttcgaggggccaaagctgacacacccattgaagaattcacaccaacaccggctttcccagccctacagtacctggagtccgtggatgaaggtggggtggcgtggcaagccggactaaggaccggggacttcttgattgaggttaacaatgagaatgttgtcaaagtcggccacaggcaggtggtgaacatgatccggcagggagggaatcacctggtccttaaggtggtcacggtgaccaggaatctggaccccgacgacaccgccaggaagaaagctcccccgcctccaaagcgggcaccgaccacagccctcaccctgcgctccaagtccatgacctcggagctggaggagctcgtggataaagataaacccgaggagatagtcccggcctccaagccctcccgcgctgctgagaacatggctgtggaaccgagggtggcgaccatcaagcagcggcccagcagccggtgcttcccggcgggctcagacatgaactctgtgtacgaacgccaaggaatcgccgtgatgacgcccactgttcctgggagcccaaaagccccgtttctgggcatccctcgaggtacgatgcgaaggcagaaatcaatagacagcagaatctttctatcaggaataacagaggaagagcggcagtttctggctcctccaatgctgaagttcaccagaagcctgtccatgccggacacctctgaggacatcccccctccaccgcagtctgtgcccccgtccccaccaccaccttccccaaccacttacaactgccccaagtccccaactccaagagtctacgggacgattaagcctgcgttcaatcagaattctgccgccaaggtgtcccccgccaccaggtccgacaccgtggccaccatgatgagggagaaggggatgtacttcaggagagagctggaccgctactccttggactctgaagacctctacagtcggaatgccggcccgcaagccaacttccgcaacaagagaggccagatgccagaaaacccatactcagaggtggggaagatcgccagcaaagccgtctacgtccccgccaagcccgccaggcggaaggggatgctggtgaagcagtccaacgtggaggacagccccgagaagacgtgctccatccctatcccgaccatcatcgtgaaggagccgtccaccagcagcagcggcaagagcagccagggcagcagcatggagatcgacccccaggccccggagccaccgagccagctgcggcctgacgaaagcctgaccgtcagcagcccctttgccgccgccatcgccggagccgtccgcgaccgtgagaagcggctggaagccaggaggaactccccggccttcctctccacagacctgggggatgaggatgtgggcctggggccacccgcccccaggacgcggccctccatgttccccgaggagggggattttgctgacgaggacagcgctgagcagctgtcatcccccatgccgagtgccacgcccagggagcccgaaaaccatttcgtgggtggcgccgaggccagtgctccgggtgaggctgggaggccgctgaattccacgtccaaagcccaggggcccgagagcagcccagcagtgccctccgcgagcagcggcacagccggccccgggaattatgtccacccactcacagggcggctgcttgatcccagctccccgctggccctggcactctccgcaagggaccgagccatgaaggagtctcaacagggacccaaaggggaggcccccaaggccgacctcaacaaacctctttacattgataccaaaatgcggcccagcctggatgccggcttccctacggtcaccaggcagaacacccggggacccctgaggcggcaggagacggagaacaagtacgagaccgacctgggccgagaccggaaaggcgatgacaagaagaacatgctgatcgacatcatggacacgtcccagcagaagtcggctggcctgctgatggtgcacaccgtggacgccactaagctggacaacgccctgcaggaagaggacgagaaggcagaggtggagatgaagccagacagctcgccgtccgaggtgccagaaggtgtttccgaaaccgaaggtgctttacagatctccgctgcccccgagcccaccaccgtgcccggcagaaccatcgtcgcggtgggctccatggaagaggcggtgattttgccattccgcatccctcctccccctctggcatccgtggacttggatgaggattttatttttacagagccattgcctcctcccctggaatttgcaaatagttttgatatccccgatgaccgggcagcttctgtcccggctctctcagacttagtgaagcagaagaaaagcgacacccctcagtccccttcgttgaactccagccaaccaaccaactctgcagacagcaagaagccagccagtctttcaaactgtctgcctgcctcattcctgccaccccctgaaagctttgacgccgtcgccgactctgggatcgaggaggtggacagccggagtagcagcgaccaccacctcgagacgaccagcactatctccaccgtgtctagcatctccaccctgtcttccgaaggtggagagaatgtggacacctgcacagtctatgcagatgggcaagcatttatggttgacaaacccccagtacctcctaagccaaaaatgaagcccatcattcacaaaagcaatgcactttatcaagacgcgctcgtggaagaagatgtagatagctttgttatccccccgcccgctcccccgcccccgccgggcagtgcccagcctgggatggccaaggttctccagccaaggacctccaagttgtggggcgacgtcacagagatcaaaagcccgattctctcaggcccaaaggcaaacgttattagtgaattgaactctatcctacagcaaatgaaccgagagaaattggcaaagccgggggaaggactggattcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtctgctgccaccgcctctccttctcccgctctctcagatgtctttagccttccaagccagcccccttctggggatctatttggcttgaacccagcgggacgcagtaggtcgccatccccctcgatactgcaacagccaatctcaaataagccttttacaactaaacctgtccacctgtggactaaaccagatgtggccgattggctggaaagtctaaacttgggtgaacataaagaggccttcatggacaatgagatcgatggcagtcacttaccaaacctgcagaaggaggacctcatcgatcttggggtaactcgagtcgggcacagaatgaacatagaaagggctttgaaacagctgctggacagataaggacggctgctctccacctcgcagactgctcttgttataagtagagatgggctcgtgctgaaacatctgaatgccaagcgaagtctgtgagcatcaaccccactccatgggtttgtctcctggtacccaaagaaatactgagttgtgtccacaacatggctgggtcttcagacccctggctcaccatgtgggtgtcttgggcagtttctatcacacatgggacaaggggagggagtttttctaacatggaaaaagattctcagcctgccgcccagcatgcaggtggcctcgctttgccgggtccgagaggctccccgtcaattttgcacgggatcctagctcttgtaggcagacaccagtgcactctagatacctcctgagacctccgtcctctgctttccgggcagctctcaccaccccaggccccggcatgaggcctttcctcagtcctgtggcctctcagaggacacctgatgctcacctgcccctctttctcctgcacttggcttgcagtgagatgctcccagatgcatttgtccagtgccccatcatgggcctgaaaggcagagaaactttttcctacacagattcttttccccatctcctcctgtggtttgcatccatggctctttggccatgaggttcctggcagtgctgggagtttggatgggatcgtgcccagctttgcttagctttctttatttctgcaaatctgttagcataattccaaggtggccaagcagatgtcacatggagttagtcaaagcacaaagtcacgattccacaatggaggggagacctggccaagggagccagccagcgtgcaactgcccaagctccaggtctccaggacaagagcagttgtctgccatgagcacccatccaggatggagaataagggcttctctgcctctcagaattctttttaattgaagatgtcttgagctctgcaaagatcagagcaggtgagcatccactttgacatgaaggacaagaagacgcatggctcatggcgggcacatgcggctgccagtgagacagcgtctcctctgggagctgggcgggcacagcatcctcagttctgtgcccagccaagggtgagcatctctgctgagacagtccttttgctctcggaggccagggaagatggtacttagaggcttttcccctatcgctctgggtgtctaggaatcccaccagcttgtcttaacagtacaacagcttctttgaggacccagtgggtatggagtatagacagaacccagggttgagaacagaaggtgggcggcaggatcagagtgaaagcagaggcgtgaggagaggaaagcagggaggtctcctgggctgccaggtcagcctctctggcaaggctttcttgagccccgcccctttctttccccggagtccctccaccccataacaatacctcgaatttccaaaagaggtcaccagatgcacatgggccgcaaaacacacagtcaggcttccagcacattctcccccatttggaggatactcgaatgtcaggtttttggttttattattatttcagaactagctcagcccatctctaattataaaacatggttttgttttttttttttcctttttttcttgattaggtctggaacagctctagaatgaacacataaaatttagcaatttaaaatctttctttactgcaagtttaaatagttgtacagatagtttataagcacaatattttaagaaaaaaaagtggctggtctactaggcagcctttgtgccacttcagtgctagaaagttaaagaaaaaaaaacttttgtgatttaataatactatttctgtggaataattataaaagtatgacctttttaaatcaaccttatttggatgcatctgaaccagcagagctgtgttatattttctatctttgctagaacttcgtcattgaaggacaatttcttcaaagtggttacaattcataatgcagcagtttctccaaaaacaaaaacaaaacacacaccacacacacgcgcttttccagtcacacacccctgatgttggaaccaagtttttggaccttctgttccaaaaccttttgcaggtcaatctttgtatttgaaatgatccaatccaacttgaagtcaattgaatattaaggcgctttacttccgtgtgctttcagtttttccatcatgagatgaatgagcattactctagataaatttcaagacaggatactacaggtggcctgctgaggctgccccatattttagaaaatgtaaaaatggtggtttggccattaatttgtcttccatttgatgataccgcaaaattccgtgagtccattcctttggcatggcactttccctgggcctacagttggtattacctctgtgctcagtgccaggcaaaacactagctcaaaggagagtcaaggaaaccgctggcagacgataaccagtcgaaactcgtgacttcggtttgttgaactttggcagccagttggtgagggccagatgttattccctttcttaaagatactccaagccacatgccactaaccacaagcaagctggctgcaagactaaagagctgataacatagtttatttttacactgtcttattatagagaagtaatagacctatcagaacctgcactgaccaacaaataaacacatgttgccaagatgaatcggtctctatctctatctgcttattttggtactgaaagcaatagttcctcattcaaatcaccacccactgttctccccctttgggacatgttaggacgaggccctattccatgcccctctttaatggtggaacaaatgttaaactgctcatctaaagatcatgttgatattattccaggttttaagatcaacttttgttacatactgtaatttaaataaactgcatttacatgcctagtttctgtaatattgtgtatacaaaacccaaatctctcaaaatgtaaattatgtatacctgccaagataccttttccagggtgtctgcgcacattttaagttaattcacataatataaaaattactcaatgtgactgttgatttgctgaactttacatatcacaaagtgaattatttgtgatactttagttaataaaatggtaaatttttttctcagttattgaacaagcaagcattatccagttgatctggcaatgactttttgtgtgtgggccacaatattgattttcccattaacaatttttttttgttttttaaatactaatatgtttcacactatagtttgtgtaacaacacgtgttcgcattatctatgttgctgttacttttgtgcttttattctttttagactttataaaaaaaaaaaaaagctcctgtaatttgcactttctcccaatccttaaatctcttgtatggcaaccaaaattactgtaaaaaaataaatatactattgcactaaggttgtggttctgattgcaaacaaacagtgaacactgtctgaattaaacaaaaagctgcccgacttgcaatctaatgtagattatctcaggcattgtggccagctctgcctctctaaaactgaccagaaaaatctctctcatcgagtaaacaggctcctgtcactgagctaatctgccttggttccatttccttattctcaatttatcaatggatacgtgcatgttatttcagaattatgcaaaacgtcaaaatctgcttctgtgaccgctgctataggcgtggagctgaggctcggcttttccttttgttctgggtggaagcagcggtgccgcggagggccagccagatccggacccttcccttagggtccagtctccccacaccccagcagggtgtcttctagccataaggccaagggagtggcagaactgggccgcctctctggttgacaagcaaaccacatgctaaggcttggagcaagagagaatttgtgtctattggcaaagaactaagccaggaagacatgggccatccctccgctttagggaagcatattttaaacctaaacgttgaacttcttctttggcctcaccagtgaaaacttgttgtctttagttcctaaagtttcttctactttggcacattccccagttgagcagcagcctctatgcttccacgttcaggaaaaattccagtcctcatatcttttgtagttcaccctcaagctctcccgcttcaccatccaatagtttctcccaaaccttggcacccccctagactttgcttccaatggtttcttccagaccacttttcctagatgaatatattcgtttaccttactaggaaaattattggaagattttttcttttacttgaaattggaggcattttaataactggcgaactggaatgtgtttctgtatttgtagacaaccatgaacccatgcaagtaggtgaacattccacagtggctgggtgaccacagcagctgcatgcagacaggactgcccgtgctttgtggggaatcagagaatttccaaacttgtttctcagacttccgcagatctcatcactttgatttctaatccatgctgtattggtgattttgtttatcgttcctgtaacttgttctacattccacagtctttaccgttttatgttcaaaattacaacaatccctgtccattgattccactctggaactctttgttcatgccaattttgaaattttaatacgagccttcaaataaacacagaaaagaaaaaaaaaaaggaaaaaaaataaagtgtgtgccttgggtgttttgaacctgatctgcataaaaccatattgtattcaaatgctgtatctttcatgaaaggataaatatatcttcaatgtattaatgtagctgataaaatagttatagtgccttgttttctgaactgagaagcccatatcaatgcacaacgtaaagaaaggacggttcgagctatgaaatgttgaggacacctacacgtgattctggagcctttctcatcataagactgtggaaaatacacagtcgtttaagttaaaaataaaaagtaaattga

SEQ ID NO: 19023 - DNA, 7394 bp, Homo sapiens
  ENST00000414786
atgcagctgagccgcgccgccgccgccgccgccgccgcccctgcggagcccccggagccgctgtcccccgcgccggccccggccccggccccccccggccccctcccgcgcagcgcggccgacggggctccggcgggggggaagggggggccggggcgccgcgcgcggagtccccgggcgctccgttccccggcgcgagcggccccggcccgggccccggcgcggggatggacggccccggggccagcgccgtggtcgtgcgcgtcggcatcccggacctgcagcagacgaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacgaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcagccccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaaggtgctcagcattggggagggcggtttctgggagggaaccgtgaaaggccgcacgggctggttcccggccgactgcgtggaggaagtgcagatgaggcagcatgacacacggcctgaaacgcgggaggaccggacgaagcggctctttcggcactacacagtgggctcctacgacagcctcacctcacacagcgattatgtcattgatgacaaagtggctgtcctgcagaaacgggaccacgagggctttggttttgtgctccggggagccaaagcagagacccccatcgaggagttcacgcccacgccagccttcccggcgctgcagtatctcgagtcggtggacgtggagggtgtggcctggagggccgggctgcgcacgggagacttcctcatcgaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagagccccaccgccccccaagagggcccccagcaccacactgaccctgcgctccaagtccatgacagctgagctcgaggaacttgcctccattcggagaagaaaaggggagaagctggacgagatgctggcagccgccgcagagccaacgctgcggccagacatcgcagacgcagactccagagccgccaccgtcaaacagaggcccaccagtcggaggatcacacccgccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgtcgatcccccatggtcgggctcaggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatgaagccatggctcagttgcctgcttgaggggatatttgtgtctgtccctcataccggccacacaaacctcctcagcctggaccacatgc

SEQ ID NO: 19024 - DNA, 5175 bp, Homo sapiens
  ENST00000445220
atggacggccccggggccagcgccgtggtcgtgcgcgtcggcatcccggacctgcagcagacgaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacgaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcagggagggggctggcaggccctgccccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaaggtgctcagcattggggagggcggtttctgggagggaaccgtgaaaggccgcacgggctggttcccggccgactgcgtggaggaagtgcagatgaggcagcatgacacacggcctgaaacgcgggaggaccggacgaagcggctctttcggcactacacagtgggctcctacgacagcctcacctcacacagcgattatgtcattgatgacaaagtggctgtcctgcagaaacgggaccacgagggctttggttttgtgctccggggagccaaagcagagacccccatcgaggagttcacgcccacgccagccttcccggcgctgcagtatctcgagtcggtggacgtggagggtgtggcctggagggccgggctgcgcacgggagacttcctcatcgaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagagccccaccgccccccaagagggcccccagcaccacactgaccctgcgctccaagtccatgacagctgagctcgaggaacttgcctccattcggagaagaaaaggggagaagctggacgagatgctggcagccgccgcagagccaacgctgcggccagacatcgcagacgcagactccagagccgccaccgtcaaacagaggcccaccagtcggaggatcacacccgccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctga

SEQ ID NO: 19025 - DNA, 7091 bp, Homo sapiens
  ENST00000262795
atggacggccccggggccagcgccgtggtcgtgcgcgtcggcatcccggacctgcagcagacgaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacgaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcagtccagctggcccaggggatccgggccctggacctggagggcccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaaggtgctcagcattggggagggcggtttctgggagggaaccgtgaaaggccgcacgggctggttcccggccgactgcgtggaggaagtgcagatgaggcagcatgacacacggcctgaaacgcgggaggaccggacgaagcggctctttcggcactacacagtgggctcctacgacagcctcacctcacacagcgattatgtcattgatgacaaagtggctgtcctgcagaaacgggaccacgagggctttggttttgtgctccggggagccaaagcagagacccccatcgaggagttcacgcccacgccagccttcccggcgctgcagtatctcgagtcggtggacgtggagggtgtggcctggagggccgggctgcgcacgggagacttcctcatcgaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagagccccaccgccccccaagagggcccccagcaccacactgaccctgcgctccaagtccatgacagctgagctcgaggaacttgcctccattcggagaagaaaaggggagaagctggacgagatgctggcagccgccgcagagccaacgctgcggccagacatcgcagacgcagactccagagccgccaccgtcaaacagaggcccaccagtcggaggatcacacccgccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatg

SEQ ID NO: 19026 - DNA, 7094 bp, Homo sapiens
  ENST00000635818
atggacggccccggggccagcgccgtggtcgtgcgcgtcggcatcccggacctgcagcagacgaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggagtttcgatacaagcggcgagtttatgcccagaacctcatcgatgataagcagtttgcaaagcttcacacaaaggcgaacctgaagaagttcatggactacgtccagctgcatagcacggacaaggtggcacgcctgttggacaaggggctggaccccaacttccatgaccctgactcaggagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacgaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcagcccgagcgggcccggcggccccggccccgcgcccggccccggccccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaaggtgctcagcattggggagggcggtttctgggagggaaccgtgaaaggccgcacgggctggttcccggccgactgcgtggaggaagtgcagatgaggcagcatgacacacggcctgaaacgcgggaggaccggacgaagcggctctttcggcactacacagtgggctcctacgacagcctcacctcacacagcgattatgtcattgatgacaaagtggctgtcctgcagaaacgggaccacgagggctttggttttgtgctccggggagccaaagcagagacccccatcgaggagttcacgcccacgccagccttcccggcgctgcagtatctcgagtcggtggacgtggagggtgtggcctggagggccgggctgcgcacgggagacttcctcatcgaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagagccccaccgccccccaagagggcccccagcaccacactgaccctgcgctccaagtccatgacagctgagctcgaggaacttgcctccattcggagaagaaaaggggagaagctggacgagatgctggcagccgccgcagagccaacgctgcggccagacatcgcagacgcagactccagagccgccaccgtcaaacagaggcccaccagtcggaggatcacacccgccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatg

SEQ ID NO: 19027 - DNA, 9768 bp, Homo sapiens
  ENST00000375835
tgcttttgctgtgagcagccccaagcagctgggcgctccatcagaggcaactatgacttttgcaaagcaaacgtgcaaccccaagcagcggtctcccgggccggggctgcgcggccgccgctgtgctggcttttaacggtgggagggcaccatcctcttgctctgctctcgttctccagaaggctgtcccggggcccccactctccgtcccgctccggggacagtggctcgcctgctatgcgcggcagcccgcgccggggccggcaccagcagcgcccgggcggatgcagcgagcccacggaggggcatgcttccacgcaccaagtataaccgcttcaggaatgactcggtgacatcggtcgatgaccttctccacagcctgtcggtgagcggcggcggaggcaaggtttcggcggcgcgcgcgaccccggcggcggctccctacttggtgtccggcgaggcgctgcgcaaggcgcccgacgatgggcccggcagcctgggccacctgctccacaaggtgtcccacctgaaactctccagctcgggcctccgcggcctgtcgtcggccgcccgggagcgggcgggcgcgcggctctcgggcagctgcagcgcgcccagcctggccgccccggacggcagtgcgccctcggcgccccgcgccccggccatgagcgccgccaggaagggccggcccggcgacgagccgctgcccaggccccctcggggggcgccgcacgccagcgaccaggtgctggggcccggagtcacctacgtggtcaagtacttggggtgcattgaagttctgcgctcaatgaggtctcttgacttcagtacaagaacacaaattaccagggaagccatcagccgcgtctgtgaagctgtgcctggtgcgaagggagccttcaagaagagaaagcctccaagcaaaatgctgtccagcatcttgggaaagagcaacctccagtttgcgggaatgagcatctctctgaccatctccacggccagtctgaacctgcgaactccggactccaaacagatcatagcgaatcaccacatgcggtccatctccttcgcctctgggggagacccggacacaactgactatgttgcatatgtggctaaggaccctgttaatcgcagagcttgtcacattttggaatgctgtgatgggctggcccaggatgtcatcggctccatcggacaagcctttgagctccggtttaagcaatatttacagtgtcctaccaagattcccgctctccatgatcgaatgcagagtctggatgagccatggacggaagaggagggagatggctcagaccacccatactacaacagcatcccaagcaagatgcctcctccagggggctttcttgatactagactgaaacccagaccccatgctcctgacacagcccagtttgcaggaaaagagcagacttattaccagggaagacacttaggagacacttttggcgaagactggcagcaaacacctttaaggcaagggtcctcggacatctacagcacgccagaagggaaactgcacgtggcccccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgatccggacaaaggacagagtctttgacagtatcagccacctcatcaaccaccacctagaaagcagcctgcccattgtctctgcagggagtgagctgtgtctccagcagccagtggagaggaagcagtgacctggccagcactgctcccagcactgcgcaccaggtcaggaggacctggagtggactagaatcggggctgctggaactgggacagctgcctgtggctcagagccttcttcaaaagcttcaaaaggaaggcttcctttaaggtcaagtttcataaacttggttctgaatttctcatatgcatattaaaggtgtacatacctatacatcctgtacaaattatccctctatatttatattttttaagactaagaaagatgtaagactaatgttctgtgctgtatgtttttaatgaaaaaaaaaaataagtttaactgtagttgtccaggcaaaaatttaattcaactgacccatcccaccgggaaatgccactaggaaggtgtagcctgcagttttacctaataagcacaactggaggggaatagaaacacagaattgtgagggaatcgcaaggcatgctgctcagagcatgcctagccctgcactgaaagctatgagatactggttctgaggcatggctgtgcttgctggtgggagcgggcatcctcccttggcctccctgggacacctcctgtgctccctgcactgcactccacgtgcctggggtgtctacacaactcgctgcagcttcactaaagaacaggtggcactccagcttctccgggtcctgctgagcacagggccccgccacccttgaccccagttgtgcgaggagtacttgggaattcatttcatgccaaaatggcacaaaataagcttcaccaaccaagattttgattgacaagtgcttccctgttctcatgtatctaatgctaaaatgggtatttgtagaagggtggtcggggcaaattcctggtttgtgtctccctctagtcagcggttgactacaggctgcttatggtaattgctagtaaagtcccccgcccgccttatacaataggggagaagcctgtgtgacagcaagagcaggcacccatcccagagctcagtcccgaagactcaggtattgaggcttctggggctgcatgtgccagaaacccaggagtcactggaatccatttgaggtactgcctctggcatgagggatgggggaaaggcctgctgtcccaacaacaaggtttctccgttgctgcagggaagagcatgtgcctgcccccactctttgtcttgactccctttcttccaggtaaaatactgtcatttcctgaggagtcatttggtgttagaaagctggcaatgtttatacctttcaaatactatctgggctgagattgccctgtgattttcacagatgccctttaaagaatagatggatccatttgcttgctggcagcgtggctcttgttctggtgagaccccacagggtacagcaccctgtagggtatgggtcagcagaacagaaagacacactaaacacgcttagagttggatagtgataaatctgatcctgtaaggagagttatgaggagactgaaaaatctggcagataataatactgctaagttctaatgccaatggtatgagccccatttctgccttggggtgtgcgtgtggccagatggaaggacaggttagagctaaccagtgaggatgagtcagggcaggccccagccttcatacatggccttctagggagtctttgcctttgagggtccagtgaatttgagatgacagtgaagtcagtgttctagaatgttctgcagtggattgaaactctggagagtctgacactactgtagactgcactgctgttttctgaaatggttttggcttcaggcatcatgtggatactctgcttagtgatccagaagcagacggctccacggggttgctggcagcagctgcatcaggctcctgccccaagacagcatagacttgggtgctctgagagctgccctgcacatctgtcctctgggaggctgggagccctggagagacacacacagctctgacccacctgtgcatgaatgtgcaccacatagaaaaatgtgcgaaatgaccttctttctacattcatgcattccccacttgtgaaaggtcaaaatgctattataacattcagggacaatagcaaagtaggaaatgcaagttaggagctgtgaatgctgtaacatttgatttactttatttttctcttggggggacttgaatggtaacctgcagctttagtagctcttgctgtgaagtcagtgtctagttcgatggtgatagaaaatatatatattttttgcatgagaatcaatttagaaaatttaaagtattggagtcgaattttttctttttaatattaattcaaaatatacatttttaagctcagattatatattggttacactagaatagtgccagtgaagtgagcaggcttcagacatagcagatggcagcgattttctaatctttgttccctcccatttgtaaagtgggttagagcacacattagttatcccaactcttccctccagcactgtgtggtgggccattcctgtgagcctcacagacacatggggaaagtgaggctggggctggtgccacaccttcctggaggccatgttgtcatctggctgcagagctcttctgctcactcagcatttcgtgagccctgctgtgtgccagcctgtgctttgagctcaggattccaaggcaaaagcaatggaggctcctccctgtctagcctgggcccctcttccccacactttctcaggccacatctctgcctgggcagggcagggaagctgaacaatgaacgcagcgggaatggcattaggccttgcgttccagggcctcaggcttccagggcacagtcgctgctgctgtgctgggccaccctggtcctgcagagtgcacctgggccctgctgtccctccaatgggcacccccaacacttaaccccaaactctatgtcttctgggagtacaaggtgggggccagcagtcctaaaacggcccctctgcccttaccgagtggccctagagacccccacccacctcccctaaccccacgaatgaatcagctgtgcttcaaatgacatctctgtcccacggaggccggctgggcctctcatgggggtgctcattgtggtttaagtcagctttgattcttgacctccaaggctgcctctgagtagctaaccggagaatcgggtggggaggtgaaaaacaccgcagtcaaatgactcaatctttaatcctgtgcttaagacaccactgttgctgttttttatatttgaagcacccaaagactgggcgtccgctcagccttgatgagcgagcagctattttgtcaggccatctatgatgttgggataatggacaaaggcctgattgggccatatatggccttctttagggcctcctggaggtggaggaagttgtgggtaatttctaataaagacgggaaatgacaagccgtgtgtgtaggtaaagtcctaacttaaaaggaaggacaggcctagggaagggtggaccctaaagggcccatgtgccaggggaacagtggacatgtgtgtccagcccaacctccatgtctggtgctgggattctgaaggtggcccccagctcccaaaataaagctttccttttcagtagcgtccgacacttgggtagcttctttctataagcaatgcttgaagatggacgtctgggtcctcatttcctccaaactggctgctacctgaaggcagtcacacatttcttttctgttgggctgagctgggcagaagcctcggactataggcctttccagggcagaggcaatgcgggccacgagtagatacctccatccagcctccaccctggcacacccagaacggcgtggactcaggcgggttgctggatttctctgagccttggcgtgctctacactgcagggctatacatgttcccagcttgagggcgtgctggggattgacaaatatatgaaacatataagcgcaatgattttctaaaattgtgcattcccagcgtgcccattggttctctctcgctggcccaactttgtgtgctgtccataaatccctttctgtggacggtgacagtaggattgggagtgagtgggaagattgtggaaagattgcaaagaggtcattgcaggactcagacagaccttgcagtgggtttcagagtaatactcaggttctcccatggaactttcaaagctggctctaagaaagatgaagaggacaaacccactcctggacatagtgccaacctagaactgtcagctccacacaggatcacagggaagggagcttggtaagacagcccagtagggggccctgcttttcagaagaggaaactggagccatgcaagggcctggggatcaacttagaaaagagcacaggactcacagtcctgggcctgcacgtaaagctagccccctgccccacggaaatggcaagcagtgcttccctccaggggttctacatctgtgctccatctcaaaatgcataaaagcctgagtcattcagatgggagagacagtgtttctacttcctcttagttggggttcctccagaaggagaccctgagagaggacttgaggttatgtagtttatttgagtgaagatcccggaagtagggagagaaggaagctgacggggaaggcgtgcattatcaagtaagttaccgtcatgtgcacaactggagctgaatcccaccggggaaccccgagagacagagctgacaccccagagttcacccagcaaggcggggagacagctggggtatttattcaccaagtctatcacttatgaaaggctgtttctggaaacaatttctgactggccctgcacacacctgagcatacttcctaagccggggatgtccctgagctgagacaggcgttcgtgacaagcagacttcgagtggaaggcaggcatcagaaccaccctgtgagctggttcagacaaagattgcaggcccttccacccccctggccccgccaagttcctgactccctaggtctggagtggggcccgggaatttgcatttcaaaaaatctcgaggtgatgctggtgcagctgctctgaagtcttgactttgagaaccactcactagtgagagtttccagcccttacctgtctcttattgatggctttcccccctctaatttataattatgctttcacaccacttcatgtcacagatcccagggtccgtgctgtgaatttaaaagtggagaattaataagcatttataactccatgcaaccattgctggcagcttaaatgccatctgccagccataatttatttataatggggtttatacatatttataagtttgcaagcaacaaatgcacagttttaaaactggcacattttatagcagccagaaaaattgcaactttataccaggacttgtgaatgtgaattgcatatgtatatacatatacgcatatacttacattgattaaaaacggatctgcatctctgtacacacgcagattggctctgtgttgtgcaccttgggactcctccctgggctttggttttacagctaagtaggaagtcaaacaaacgtgaagaatttgggaattggcaggctgtggcatcagccatggaggatggtcctggatgctgtaggatgtgagatccagcacaaagagaacaagaacaggacatgaggaccacagggattgggggaacccactgtgggaaatgacagagaagccagtgggggaagacaaagaaagaagaaggtggaggcagaataaaggtgagaagaagggaaggggaggataaaacaagtccagatttagatcttccttcatgcagccatgcatagctgtctgaggccagcagggaaggaggagaaagggaaggtgtggtggaggaggctgtgctcgtgatgtcatgctttcgtgtattcccaggtgcagctgcatatacttggcacagtttcttgggatttctagccagtttcttggcctcatttgtgcattagttaatatgtggctggccctgtactgggatggtgggatagagaagtgaatgtatgaggcctctgcctgagtttataacctagaaagaaataaagacacacacacacaaaggtgttggagtgtgacaagccttaaggtacccgtgtgtccaagtaaagtagaaccagcaagggtggagtgcccaggtcagtctggggactctggaggcttcgcactgcaggcgtcagatactgagtgttagtggcacggagaagagtgtggaaggctcaggatgggggtggacagcctggagttgtcactctcagtagagatgctagaaggggcgggaggtgatcccagcctcccttctttcctcctcctggctgtcacagatgctctgaattgatgaatccttcaggccaaaaacacacaggctccttccctaggtctggaaaaatggttctcgctgaaaaagcaccaggaataaaatctcatacaattttaggtgtctattttgttgtctcaccttgaaatactgcagacagaaaaacatgcacatggggagctgtggtcctgagctttgaggtaatgaattcccactcatgtgatcatttttaccataaccaaagtttctaaccatcaaaatcaagtgacaattaaaacaggcattaatggataaatccgtctttaaatattaatggggttaattttgttaacagctatgtgttggttgcaagtggaatgttctctgttcatttgacttttgaatataacttgttccagaatattgtaaaattaagtatgtgaatgtttctttgtattcagaattaaacatttggtgttaaaatcccaggattaggagacaactccatgtaaatttaatgtgtaataataagataataactttttaaaaagcatttggatggcaaattatacatactgacaaatgaatattatctgaaagttgttttgtttccattaacttttgtgaaacaaaaagaattactgtaacagtctatgtcttggcgtattgccaattcaccactttctactttgtgctggaacagaactggcttttttgacatccctgaggagtggaaatgcaaaacgaatttcaagttctctaatctttgttctatgacaaatgaaaaaacctaagttatctggtgttttggagatttgagaatacagcaggtgaagagaattagcttaaattccctcctcccttttgataaatccacagggattccttcactctgtcaggaaatggtgtggtttccaagcattagcccttcatgatctgtctggtgcatttctgtgctcctgggatcgccaagtgcaggcacggcatcgcatccccaggtgtcatcctgtgacccaggaggggaagatgacacacccaatttaggtaatgctgcacttcttgttataattggttattggaaaatgtgcctttattatcagaacagtggtgtgcgcatttctgattatggagctaacttttggatatctgacttagatactaaaaacatttgggtgttgcagttttgcacttgtagatacaacttaaaagcatgaaactggtgatttaattagatgttttctataaaatgcaccttgttacatttctgtgaaagggtcttaccagcgtggaataactggctcaagggttgagagaaacaaccattttctaaacagttaattgtttaaaggactatacatgtaagtctgcaggcaataaaggctgttgtgaaaagta

SEQ ID NO: 19028 - DNA, 569 bp, Homo sapiens
  ENST00000375831
cccacgggagaagcacccacctacgtcaacactcagcagatcccaccacaggcctggccggctgcggtcagcagtgctgagagcagcccaaggaaagacctctttgacatgaaaccttttgaagatgctctcaagaaccagcccttggggcccgtgttaagcaaggcagcctccgtggagtgcatcagccctgtgtcacctagagccccagatgccaagatgctggaggaactgcaagccgagacttggtaccaaggagagatgagcaggaaggaggcagaggggctgctggagaaagacggagacttcctggtcaggaagagcaccaccaacccgggctcctttgtcctcacgggcatgcacaatggccaggccaagcacctgctgctcgtggacccagaaggcacgagaagtaactcctactgatgttggccatccctggcactacagctgtatctgaataatcccgtaggtttggctgaatttttcatcttcccgtcaagaaagacattcatctttacctggggcatagtccaagaattgctaagtttaataaatgcagttaaatc

SEQ ID NO: 19029 - DNA, 4558 bp, Homo sapiens
  ENST00000332408
agaacagaaggctggggtgagggtgggagtcgggtgctaaatatttctactaggctcctgcaaggctagtgatgcagcgggccccccgaccggcgctcgcccgggttctgcgcctaagagttggccgtgagcgacccgcgccgccgggagcctgggtctaggctctcccgacaaggattccaaggcgagaacactggtgcctctgcctgggccagggagagactgaaatcagagcaggggaggcgtttcccccatgggctgtcacccttaaggggccgggagccgaggtgggcgagctcgagagcagagttggagaggtggctgctgtgagttgcatcgggcgttgaggtatctgatgtctgcaccgtttatctaccagacgacgaggcgatttatgcaacagtatcctgtttcagcactgccaaggctatgcgagaacgcggccaggacagcctggcaggactcgtgctgtatgtaggactcttcgggcaccccgggatgctgcacagggccaagtacagccgctttcggaacgagtcgatcacgtccttggacgaaggtagctccggaggctcggtcgggaacaagggctcgccgcagcctccccaccccgccctggcacctcacctgccgactgaagatgccaccttgccgtcgcaggagagccccaccccactgtgcaccttgatcccccgcatggcaagcatgaagctggccaacccggccactttgctgagtctgaaaaacttttgcctgggtaccaaagaggtgcctcggctgaagctccaggaaagccgggacccaggttccagcggcccctcttccccagaaaccagtttaagtaggtccgggactgcacctccaccgcagcaggacctggtgggacacagggcaaccgccctaacccctgattcgtgcccgcttcctggccctggggagccaacacttaggagcaggcaggacaggcactttctacagcacctgttggggatgggcatgaactactgtgtgaggtacatgggctgtgttgaagtgctgcaatcaatgagatcactggattttggaatgagaacccaagttacaagggaagcaataagtcgcctgtgtgaagctgtccccggggcaaatggagccattaaaaagcgaaagcctccagttaagttcctatcaacagtccttggcaaaagtaatcttcagttttcaggaatgaatataaaactgaccatctcaacatgcagtctcacattgatgaatcttgacaaccaacagattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcattggactgtcccatttgctggttaaaaggattggggcccaaatcctctggcctagcatttctcagtgtttgctattcagactgtctaaatacagcatgtgacaagctgaagaagccaaatctatcagtcatttctgatttcattatattctccccctcttcctgctaaaaagacaaaaaacaaaaaacaaaaaaaacaaaaaaaacctcatgagtgcatggatttaaaagagggcaaacaaaaccagtattcttcatatttactattcaaattggtttcattcttagtaaaagtacagaatctatttgaaattatagtaaaatttcttcttgattggctgacactgaatcatagtttctcacctacatatatccttagcacctcgtatagatatgatcagacaaaatgcagaaggaaaaaaaaacatattgaatgaagcacttggaaagattttccacatgtagaccaactggtaaactaacagagtgattaagcatggtgtacagaaaagcattacgctgagtcttaccagtgtgaccttcagcaagttgctgaatctgtttgggttccagtttccttggcaataaaatgagctaaatgggctaggtgaatttggaggactacttcagtcctaacttatagtatgagtctctaaaaagcaagtttttcatttgttagaggtcgttattgataaccagtctgtatagttaaggtaaaaaattaagcttttcttctatagtctgtgtccatactcacagaatgaatggcacacctgagatcaacattcacatagtttagactccaaaccattcagtctaaaatactgaaactttggaatatagggaatgatgataaaagtggatttggtttgagtagcagaaaactacttatgtccttttcttgcctttccaagaaaaatgttttttgtttttttttttaatcttgagttatctggatattgccttgactccatttcattttggctatgtagatacaacttagtctttgtgattgtgatatatttgctaagttttaaataaaacttcttttggatagaaatcattagaaaccaagcatactgcactctaatattttactgtaaaggcttatgatttttatttctactgccattaattttttagatggatttgtttcctcttacacaactagaattaatgtatttttcaccagttttccatataccttaggtcttgatcgtttgtccttaaaaaggggatcagcatgagtatagacagtagaaatgtatgggtagtctaaccacttttatcagagacagagcagggctgtggtctcactctagctgagcagagtattaacttggtagcaagagttcctgatacaaatagatgcaatgactgtaaatggtgtcagcagtacacatggataatcagtatttgactgtaatagtatagtagttaaatacagcacttaaaaataccacagacacagttaaagcaaaaggaaacaataaaaggaatgtctgcatgctattttaatctcacattctttatctgtcttaaagtggaaatccatttgcctataaatacctgtaaacgactttaaaaaataaatgattattgctttgtgacaattgaca

SEQ ID NO: 19030 - DNA, 2799 bp, Homo sapiens
  ENST00000396535
tttttaaaaacatgttttacctgtttttaccttcaacttaaaagcctcaggttttaagttgtatatacttatatgaattatatgactgtgtatacttacaggattcaagcacatttcatttattctgcactttatttctattattattacattatagttatgtagaattatacaactcaccataatgtagaatcaatgggagccctgagcttgttttcctgcaactagatggtcccatctgggggtgatgagacacagtgacacccgaggtgtgttccttatgtccggtctattctgtaatctcattttggttgctgttactgtggaaaatcctgcctcacaaagataggatgttgaaaatggaaggaggcttttcagtacttttgtggcaatctcaggatgttccgccttgactttaatcgagaacgtatggagatttgaagttgtctcaaacatacttttaaggccaccgtcatttgcaatatcaagcagttgatcctcttctagcgtggacaaagtggattcacctggcttattcacaaatgggtcacagatccattccgtcttttgtggatgagaagtgtgatggttaatactgagtgtcaacttgattggattgaaggatacaagtattgatcattggtgtgtctgtgagggtgttgccaaaggagattaacatttgagtcagtgggctgcgaaaggcagacccacccttaatctggttgggcacaatctaatcagctgccagcttggctagaatataagcaggcagaaaaatgtgaaaagagagactggcctagcctcccagcctaaatctttctcctgtgttggatgcttcctgccctcgaacattggattcccaagttcttcagtttcagaactcggactggctctcctctctccttagcctgcagacagcctattgtaggaccttgtgatcatattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcattggactgtcccatttgctggttaaaaggattggggcccaaatcctctggcctagcatttctcagtgtttgctattcagactgtctaaatacagcatgtgacaagctgaagaagccaaatctatcagtcatttctgatttcattatattctccccctcttcctgctaaaaagacaaaaaacaaaaa

SEQ ID NO: 19031 - DNA, 1447 bp, Homo sapiens
  ENST00000537958
aggtaccgcctcctacttggcgcgccactgtggttggagtagctcagtgttttctccggggtgttggcgtcgccttttgagctacgtttccatcgattcgaacttcgtatctagggaccctgcatgcaagagcttatagtgaagaaatacttggtcccatttcttttcgcctgggaggtatctttccactattagcaatgcgattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcag

SEQ ID NO: 19032 - DNA, 821 bp, Homo sapiens
  ENST00000557797
gaagaaatacttggtcccatttcttttcgcctgggaggtatctttccactattagcaatgcgattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacat

SEQ ID NO: 19033 - DNA, 885 bp, Homo sapiens
  ENST00000558220
accgcctcctacttggcgcgccactgtggttggagtagctcagtgttttctccggggtgttggcgtcgccttttgagctacgtttccatcgattcgaacttcgtatctagggaccctgcatgcaagagcgtaacagtttctgtgttacttaaccctactgctgcttgtaatgctgcaaaccggaaaataaccttacatggccttcgtaacatttaatgctccttcccccccttcctcttcccctgggcaatttaccgatgtactgatgacttgtaaatccacgtctccaaaccagacaacatccataaccacagatcagcatattaagaactaatccattttgtccttttagtgttttcatttaaaaagttaaattcacaaacaacagatatattgtactttttttttttttagttatagtgaagaaatacttggtcccatttcttttcgcctgggaggtatctttccactattagcaatgcgattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttg

SEQ ID NO: 19034 - DNA, 864 bp, Homo sapiens
  ENST00000559289
gcttgttttcctgcaactagatggtcccatctgggggtgatgagacacagtgacacccgaggtgtgttccttatgtccggtctattctgtaatctcattttggttgctgttactgtggaaaatcctgcctcacaaagataggatgttgaaaatggaaggaggcttttcagtacttttgtggcaatctcaggatgttccgccttgactttaatcgagaacgtatggagatttgaagttgtctcaaacatacttttaaggccaccgtcatttgcaatatcaagcagttgatcctcttctagcgtggacaaagtggattcacctggcttattcacaaatgggtcacagatccattccgtcttttgtggatgagaagtgtgatggttaatactgagtgtcaacttgattggattgaaggatacaagtattgatcattggtgtgtctgtgagggtgttgccaaaggagattaacatttgagtcagtgggctgcgaaaggcagacccacccttaatctggttgggcacaatctaatcagctgccagcttggctagaatataagcaggcagaaaaatgtgaaaagagagactggcctagcctcccagcctaaatctttctcctgtgttggatgcttcctgccctcgaacattggattcccaagttcttcagtttcagaactcggactggctctcctctctccttagcctgcagacagcctattgtaggaccttgtgatcatattattgcaaatcatcatatgcagtctatttcatttgcctctggaggggatcctgtaagtatggattcacagaagttctttttatgagttaaaataacttcttgacatttggggctggatgataataaaa

SEQ ID NO: 19035 - DNA, 2062 bp, Homo sapiens
  ENST00000560540
gccccatgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccagctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagca

SEQ ID NO: 19036 - DNA, 2500 bp, Homo sapiens
  ENST00000290894
gtactaaccactatacgatcacggcgagctaccgggacgccacgacgagcagctgacccagtgttgcccttctcgtctagatggcggccattccagctttcctaagcgtccattatctaccaggttcctcccgcacccacgttcacccgcaagagcagccgggagcgctgtggactccctagcccgaagtctcctcttggctgtacgcacggaccgcaaaagaagggacatgaaagtgctttgcaaccaaaggattcctatgaggccgggcctgcaatgatgtgaagcccctgaggacgcccgaatggtggcccaaagtctctctgacgctcaccatgccctgactatcatgctatctgaacgactttggctgggactggagctcttaaattttacaagaaggaaaatcagttctgacccaccaccatacaacttccttgaggcgcgagggtgtccacaatctccacagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaatcagctctggagcagacacagcccggctgtgaaaagca

SEQ ID NO: 19037 - DNA, 1731 bp, Homo sapiens
  ENST00000560734
catgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcaggagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctggaggaagggggttccagagctactgggatggtagggagtttcagactggcagctccggctcctttccgaccttagggcagaggtggtgacctccaccaccaccaccctctccccactgggtccgtgcgaggtagtgcagaattcggccccttggggcgccttaccacctctctgcctccgtccccgacttccaccccagaccgtcggagggctccgcccagagtctggtaagaggtttggggaagacaggcccctgggaagcagccggctttggggggtggggagagaaggggaggggctcgggcagagggaactgtgcagtccccaggccgccccggctccgggccagaggcaataaataaacccgatcctgccgggcacagccgcgcccgcgcctccggcgccgtccccgggctgacgggggagggagcggagaagcgagcgcagattctgcgtataaat

SEQ ID NO: 19038 - DNA, 1163 bp, Homo sapiens
  ENST00000458022
gagttgccacctgggtgcccatgggcactgcaggctagagctgaggaggcccacgccagcctcggaggggtcgcagctctgggcatgggcccaggacttggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctgggatccagtagaagctggagattccttaatttattctaaagggaaagggctcctggggccttggagtaaggggttgtctggagctggggaaagaggaatccctggagagaaaggatagcccctg

SEQ ID NO: 19039 - DNA, 604 bp, Homo sapiens
  ENST00000558294
ccccctggccccgggagtcccgcctgccagaggatgatgagaggccccctgaggagtatgaccagccctgggagtggaagaaggagcggatttccaaagcctttgcaggggacacccacaatgggtgggcctggacagcgagggacccagcagagatgccccccttcctctctctcatccttagctggtatcacggggccatcagccgaaccgacgccgagaacctgctccggctgtgcaaagaggccagctacctggtgcgcaacagtgagaccagcaagaatgacttctccctctccctcaagagcagccagggattcatgcacatgaagctgtcccgaaccaaggaacacaaatatgtgctgggccagaacagcccgcccttcagcagcgtccctgaaattgtgcaccactatgccagccgcaagctacccattaagggagccgaacacatgtccctgctctaccctgtggccatccggactctttagatgtgaagccagggcactgtgatagacctgtacccagccctgtgcccatcacctggctgagggctgtggctcttgccagggacgtgatctttcaaacctttcttctcctggga

SEQ ID NO: 19040 - DNA, 603 bp, Homo sapiens
  ENST00000561239
cagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctgctgtcatactctaggagtctgaattgtaaaatcaaagaagcatttcccagaaaagtttttgtcaaaaatttgatttacataacctcagaaatgtgtattgctttaaaaattataaagttcatggagcataccaagcagcctgtataccatttctaaaccaactactcccctgcaagatagatctcttttttatagacagaaaataaattcaaagaggtttgttacttgcccaaggccacccggtaataaagtccccaaaccaggatttgaaccca

SEQ ID NO: 19041 - DNA, 2499 bp, Homo sapiens
  ENST00000560471
ccccatgttactgagcggagctcctccggctggctcccgcccggggccgcgaacgcaggggagcgctgggggcggcccgggggggtcccgccggggcgccgggggtgcgggagccggcccaggagggggcggcagcggcggagtagccaagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccagctggtatcacggggccatcagccgaaccgacgccgagaacctgctccggctgtgcaaagaggccagctacctggtgcgcaacagtgagaccagcaagaatgacttctccctctccctcaagtgagtggggacagttgtggtttcagggacagcaagcagggtggaaggggactccagtattccccttatgcccaaccaagctggggaggtccccatcccccatgaacaatccccaggcactgggggtcctgagatgtctgagactcagcccctgctctcaaggagctcagagtccattgggagaaatagttgatccgcagcatccagctcagaagggttctgttctagttgtgtggcctggcccccttaacctctctaggcctcagtttccttactaatgaaatggatgggggataatatagggaaggattaggtgaaataatgcatgggaagtgcttagcatagtgctaagggctcaataaattatcactgtcattattaatggaagcccaagatgttctagaagcataggcaaggagataggagctttgcgtgagggagtctgtagggtgttggggggggctggttcctggaaggagggcagggcagtggacacaaagtatttctgtttactctgaggaagagtgtgtgtgtctgtgtgtgtgttcggggatggggggtgtctgagcttttgggtcctggaagacgtagaggaggcaaggccctccctccccatcaggctttcctcccaggagcagcagatcagcctcccagactccctggtagcatggccagccctgccctgggcaaccaggagttctgcctggtagaccctgcaccccgttaggaagccagtggggtggtatgttcatttgccccccaccatcactagtaggacacctgcaccactttctaccacattctctgggaccatcagagtacagatataccctcccattcagacaaatccaatctatgggaacttggggctgctaaacaagacatatttgggggataattattcaacttccctcaaagataatagaaaaagtggtgggtgtgttggctcacatctgtaatcccagcactttcaaaggccgtggcaggtggatcacctgaagtcaggagttcgagaccaacctgaccaacatggtgaaaccccgtctctactaaaaatacaaaaattagttgggtgtgatggtgagcactggtaatgccagctactcgggaggctgaggcaggaaaatcgcttgaacccaggaggcggaggttgcagtgagccgatattgcgccattgcactccagcccaggccaacaacagcaagactctgtctcag

SEQ ID NO: 19042 - DNA, 884 bp, Homo sapiens
  ENST00000559566
ctggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtctggtatcacggggccatcagccgaaccgacgccgagaacctgctccggctgtgcaaagaggccagctacctggtgcgcaacagtgagaccagcaagaatgacttctccctctccctcaagtgagtggggacagttgtggtttcagggacagcaagcagggtggaaggggactccagtattccccttatgcccaaccaagctggggaggtccccatcccccatgaacaatccccaggcactgggggtcctgagatgtctgagactcagcccctgctctcaaggagctcagagtccattgggagaaatagttgatccgcagcatccagctcagaagggttctgttctagttgtgtggcctggcccccttaacctctctaggcctcagtttccttactaatgaaatggatg

SEQ ID NO: 19043 - DNA, 597 bp, Homo sapiens
  ENST00000558685
atgaccagccctgggagtggaagaaggagcggatttccaaagcctttgcagttgacattaaggtcatcaaagacctaccttggcctccacctgtgggacagctggacagcagcccctccctgcctgatggggacagggacatctccggtccagcctcgcccctccctgagcccagcctggaggacagcagcgcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtgggacacccacaatgggtgggcctggacagcgagggacccagcagagatgccccccttcctctctctcatccttagctggtatcacggggccatcagccgaaccgacgccgagaacctgctccggctgtgcaaagaggccagctacctggtgcgcaacagtgagaccagcaagaatgacttctccctctccctcaagtgagtggggacagttgtggtttcagggacagcaagc

SEQ ID NO: 19044 - DNA, 577 bp, Homo sapiens
  ENST00000561091
gataggctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgtatgacacaccctatgagccagaggaggatggggccaccgcggaaggtgagggggccccctggccccgggagtcccgcctgccagaggatgatgagaggccccctgaggagtatgaccagccctgggagtggaagaaggagcggatttccaaagcctttgcagccagactggaaaaccacaggattctaatattcttcctgtaaagcacacaccattgaggatgggccgtttatctccagaagtctccttggagaatcaatactgtttggattgcttaatgggaaaatctatgctcgtcattaggaaacctcgttagcagtccagcagccgccagtggcatcactcttctcaggatggggggtggggattaaatttcaataaaac

SEQ ID NO: 19045 - DNA, 578 bp, Homo sapiens
  ENST00000561278
agtgttgcccttctcgtctagatggcggccattccagctttcctaagcgtccattatctaccaggttcctcccgcacccacgttcacccgcaagagcagccgggagcgctgtggactccctagcccgaagtctcctcttggctgtacgcacggaccgcaaaagaagggacatgaaagtgctttgcaaccaaaggattcctatgaggccgggcctgcaatgatgtgaagcccctgaggacgcccgaatggtggcccaaagtctctctgacgctcaccatgccctgactatcatgctatctgaacgactttggctgggactggagctcttaaattttacaagaaggaaaatcagttctgacccaccaccatacaacttccttgaggcgcgagctagctatcctagaagactatgcggacccgtttgatgttcaggagactggcgaaggctcagcaggagcttcaggagccccagagaaggtccctgaaaatgatggctacatggagccctatgaggctcaaaagatgatggccgagatccggggctccaaggagacagcaactcagcccttgcctctgta

SEQ ID NO: 19046 - DNA, 7575 bp, Homo sapiens
  ENST00000441885
cgccgccactgccgcccgcgcctcgatggcgccatcgccccggagccgctgaccgctcagcgcctccagcccggcccgcgcggcgggtcctccgagcccggcccgccgggggagcggcctgccgcggaagcctccccgcgccctcccgcccggccccgccatggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagggcattatgggaaggatgcttaccgaagtggaggacctgatctccataacttcatctcatctggatttgtcacattaggaagaggacacaccaagggtgatcatcaatataaccatccgattttgagcagtgttacccagatcccgccacatgagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtgaccggcggggcagggccggggctgctgggcgtggcagagcagagcgggggccgggaggggccaggagcagagcttctagccttgccactctcccttcccttgtcccctctgtaggaagtgggggtgggccacctttgcccaaaaagccatacccccggggacacagccccgatggcctggtccaatacacttagacccaggaccaagagcaatcgctcttgctcctccagaagaatcagtggggagtgaggagggggctaggccccattctcacccccgaccaccttcaccaactccctttccgtcccgcgcctccttctccccatccgggggactcagctgcaggttctgtcagcagagagacccttgcttgactgtggtctgaagctgcctgggtttgaaggggccagcgggtccaatcagtgggctgaccggataggctactcggtctcattcattcatctagaaccgcatcacagaaatctcctagtgcctaaaaactgcctgctcgctctctcagagccagggagctgctgtgtccataagcacaataatgattcttttcttgcctgctggaactctctggtccccactgagtgacccttcctttgctgacccctgagggcccaaccctggccctgtgcccctcccctcaactccaggaccaggaggggttcccttccttcagctgcctccccattggtgggaactccacccccttccagctgactgcccgcccataaggaccctgggcctgtcctttcagcgggctgtgctccttccctggccctgaggatttcacccttgagttttctggggttttggctgtagccttcgcagaggggagtagcaatggggtgctggccctcccagacacccgatcatctccgcactccctccaggcctctagacctgaccatgactgccactcaggctgccttctccacccctgctctgctcccaggaggcacctgcggtggccagagagccagggtggggagggccactgtgatgtgcggggtctcgggctcaacattcgcatcctgcagggctccacctgttcccacatgcacctccggcaggacctagacagaagtttctagagagcagcttttcagcccccagacaaggaggatgagaggtggttgtcctgcatcctctccgctcatccttccttccccatctctgtctacctgctcagttcagagatcactcctactgcctgtgtccccttcccccacatcctccctgcaactttattcctcctagctgatccttcagatccgtgcctcctctggatcaaagggacaaagacctattagcaaaagcaaacaaaggtcctccaggcgactggcctaggggctaactgggcaggtccccacagcatcatccctttgtgcaggcactggggtacctggtagaccatggtcctcagctctgttgggggaccgccactgcccgcccacctcagcctcttccccgcctccagcctgggggttggcatggtgtgacggcctcctggggaggtgacagtgaattcagcagcatccgctcccccaagaccagagagcctggtgggggaaagaaggggttccctcattctcagggccagggcacccgctgggttggggctgggggaatcaactccaggctattgggtgaaggtgtgatcctaaaaacagtcagatccaacagcagtgcccttataaatggggttttacctgccctcagttctgcactcatggccctttaaaaaggcgagtgtagaaggagaatttattggtgtcagccctggagatttttaatctaaccaagtccacaaaccacagagaaagcaatggactgtgtcctttcactgatttcaagagttccaaagctctcatctccttctcccctctgcagggtgtgcctcccaacaggaacaggaaaccatcaccctggatcttagggggatggaggctgggggttgtgaaagccactgtcagaccccacactggggatgcattcctggagtcgtgcggctggaaggccagggactaccctctctgctttcctcccaacagacacataaaccttcttaagggctggtccccaggggtttataagagtttgttccagaaggtgaggctaagagggttggaaaggaagaagtgagtctgaatagagcaggtggctcccagctgggcccctgagcccagcacctttgaatcgtctaatctgtggccatcccttggaaggcaggatgctggtggtgaggggaaaggacctgagtggctgagaatgcccttcccaggtgtctacatgcaggtatacaccaaaccagaaagctgatcccatctccagtgtcaaagcttctcagcaccaagttctccagcccccagggtgacacttttccccaggggtcctccccaagccctgtctctgacagggtttctgtctctctcaggggttgttgatgagttgattccaagacatttctcatcccagccttaccactgtctggctgaaaggctctgatgtcagttgggttggaaaattctactgcaatgcttacttcttttcaaggatttcttctgcttcacctttgggtctagaagcaaggaatgaagggagggagagagggagggagggaggggaggagggaagaaaaaagaagtagagataggtctacagacttgctccaattcagtcccacatttcaaaatccagaaaactatgtcatagctgggacagagaggtatcccatttattcagctgtcccatccatcttcatggaacaagcaaagccacatcaataggcaagttcacgtagcagataaaagaggcttctggggctggaacctagatgccatgatttctagcccaaccaggctggtggcctctaccatacatagaagtaccatccacccttacagtaaaagcctccctcctgctcacaaaggaagcctaaagcccaagatttccctctccttgttttattcatttttgcacatctctgttgctctaacagaaatgaactggaatctgcacaggttctctcctgccctgaaagttctgcctggtttccttggcctctgatggcattgaagctttcacaatccctcctgcatctccaccttccctgtcttgctccaggctcctggctccatgccttcctgtgtcaaaaaggctttgccaagaattacttcacctcctaaccaggcttctgccctcagggctcccccagtgtcttgggagtgtcttgggccacacgactgcctcttagaaagttccaaccttgcccccaattcaaatttctcctcccctctttccactctccctcccagaaactcctgatttccagaaaacctcagatttccaggccaggtcactcattccttcctctcatctccctcttcctccatctaccttcctccattcaccttcctccattcctaatttcttttccctggtcttgctataatctccagctctaaaaatcagagctctcaatgaaaacaatggaagaataagacattctttcggtcttctgtttgcctcactggtgtatccttcatctcctgcccctgtgagttgataccccagtgcacggagccaagggcttttcccctctgagctctgggagggaagggaatggagctctgggtttgagatgtcatggcctgtgatagtcagtttggttcctgccactagcaagtcccctgaagctcccaacccagcctgatgttagcccagaagctcctgctctggccaaagactcctatccttgagggctctcagccactgctccaacacacttgcccccttcctgcttgtgtatgtcacttatcctcctttgtccacaaagacttgagggcctcctgagtctccaagcatggaggaatatccatgccaacatccctgccatcaaactcaatccattttcttcagagataccttgtctgtcaccagcctccaacttcatattccttccacaggcaactgtgcacttgacccaaggtaaaatgaaagggctgccaatcactcggactccagaaggtgcctgccctgagaagagctggcatgttacctcccacatacatttcctgtcatcctgtccgaatctgggaaattttgctctggagtattttcaagaaagcgcattgtgttttaatgaagtatttttcagggttccaatgttattttttataaatgcagcattttaatggcagattcaatatgaaggacatgtcttcctgggctctatatttgattttggaaggcagcatactctaggagaaaaaaagcatagggctgaggctctgaagacacagcttccagccctggctttgtctccgagggggagtcatgttccccactcagtgcctcagtttccccatctgtaaaatgaggggctttgactagatgagctctgaagtttcatccagctcttacactgtagggctttcattccctgccagcacctgctctccccgttcctccccacctccactgagctgcacacatcccacaatgcctgccccacagcgatgtcctcagatgtcctggacagccaccgcactcctcactagagcctggggtgggcctgatgggctcggccacccagggatgccctcgtacctgaagtttaagggcctaaccattcaataggtcaccaactgtgtgccatggaagccctcttgtaaagacacacctaaaccatcctaagtgactgtggaattctggggaattctgagtttggagtttccatttggatacggtccttatagctggagggaggcggttccaatttcagagagggagctggctggagagaaaggtctggaggttggcccataagggcatgaagtttgtacttgagggcagctgggaaattcatttcaagctgcagaggaacgtgttcacaggctgttgtgtggcaatgaatgtcatgataacccactctggaatatgtgtcctgaagaccaagtctggacactgaggctccattccaactggaggaggaggcatctccatctgggctgctaggaaggggcactcatcccatcctagtacctttgtagcccttcgtcatgacactaccgtcctcccggtgaaggcttgtgaagcaagaatggagagtccaagtttgtgatattcaaacccatcttgtaaatcagcaaacacattaaccttccatcagtcagagaaataatgttgtggctgtgtgtttccttaatgctctccctcctgagggaggagaagaccctgctcaactttgctgcccaccctgcagtgacccctgaatgccacaccatgggaggactcattcattggctttgtagtggcaaatattcctctagttctataactcaactagacattttgtagtaaagaattcttgaaattctctaataaaaagcaattcttactgtaatatttttagtttggggacacaatttcctaaggggggattaatgaacatttttatgcattagcccaatttatgaattccatgtttattatatggtagtactgatgaaaagtacctttctatctgtatctttgcagtttcttcgttactcatatgtaagcctcatggtaagcagtgctctagtaactgcttctctgtacaaatctcatcgttctacttacctgtcaaagcacattctacatgtactgtaaacagatacactttagtaagatttagtcttaaggatttttccacttttgtcagtaacagatatttatggattaaaaaataaagccgtttcaacataa

SEQ ID NO: 19047 - DNA, 7518 bp, Homo sapiens
  ENST00000432116
cgccgccactgccgcccgcgcctcgatggcgccatcgccccggagccgctgaccgctcagcgcctccagcccggcccgcgcggcgggtcctccgagcccggcccgccgggggagcggcctgccgcggaagcctccccgcgccctcccgcccggccccgccatggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagggcattatgggaaggatgcttaccgaagtggaggacctgatctccataacttcatctcatctggatttgtcacattaggaagaggacacaccaaggagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtgaccggcggggcagggccggggctgctgggcgtggcagagcagagcgggggccgggaggggccaggagcagagcttctagccttgccactctcccttcccttgtcccctctgtaggaagtgggggtgggccacctttgcccaaaaagccatacccccggggacacagccccgatggcctggtccaatacacttagacccaggaccaagagcaatcgctcttgctcctccagaagaatcagtggggagtgaggagggggctaggccccattctcacccccgaccaccttcaccaactccctttccgtcccgcgcctccttctccccatccgggggactcagctgcaggttctgtcagcagagagacccttgcttgactgtggtctgaagctgcctgggtttgaaggggccagcgggtccaatcagtgggctgaccggataggctactcggtctcattcattcatctagaaccgcatcacagaaatctcctagtgcctaaaaactgcctgctcgctctctcagagccagggagctgctgtgtccataagcacaataatgattcttttcttgcctgctggaactctctggtccccactgagtgacccttcctttgctgacccctgagggcccaaccctggccctgtgcccctcccctcaactccaggaccaggaggggttcccttccttcagctgcctccccattggtgggaactccacccccttccagctgactgcccgcccataaggaccctgggcctgtcctttcagcgggctgtgctccttccctggccctgaggatttcacccttgagttttctggggttttggctgtagccttcgcagaggggagtagcaatggggtgctggccctcccagacacccgatcatctccgcactccctccaggcctctagacctgaccatgactgccactcaggctgccttctccacccctgctctgctcccaggaggcacctgcggtggccagagagccagggtggggagggccactgtgatgtgcggggtctcgggctcaacattcgcatcctgcagggctccacctgttcccacatgcacctccggcaggacctagacagaagtttctagagagcagcttttcagcccccagacaaggaggatgagaggtggttgtcctgcatcctctccgctcatccttccttccccatctctgtctacctgctcagttcagagatcactcctactgcctgtgtccccttcccccacatcctccctgcaactttattcctcctagctgatccttcagatccgtgcctcctctggatcaaagggacaaagacctattagcaaaagcaaacaaaggtcctccaggcgactggcctaggggctaactgggcaggtccccacagcatcatccctttgtgcaggcactggggtacctggtagaccatggtcctcagctctgttgggggaccgccactgcccgcccacctcagcctcttccccgcctccagcctgggggttggcatggtgtgacggcctcctggggaggtgacagtgaattcagcagcatccgctcccccaagaccagagagcctggtgggggaaagaaggggttccctcattctcagggccagggcacccgctgggttggggctgggggaatcaactccaggctattgggtgaaggtgtgatcctaaaaacagtcagatccaacagcagtgcccttataaatggggttttacctgccctcagttctgcactcatggccctttaaaaaggcgagtgtagaaggagaatttattggtgtcagccctggagatttttaatctaaccaagtccacaaaccacagagaaagcaatggactgtgtcctttcactgatttcaagagttccaaagctctcatctccttctcccctctgcagggtgtgcctcccaacaggaacaggaaaccatcaccctggatcttagggggatggaggctgggggttgtgaaagccactgtcagaccccacactggggatgcattcctggagtcgtgcggctggaaggccagggactaccctctctgctttcctcccaacagacacataaaccttcttaagggctggtccccaggggtttataagagtttgttccagaaggtgaggctaagagggttggaaaggaagaagtgagtctgaatagagcaggtggctcccagctgggcccctgagcccagcacctttgaatcgtctaatctgtggccatcccttggaaggcaggatgctggtggtgaggggaaaggacctgagtggctgagaatgcccttcccaggtgtctacatgcaggtatacaccaaaccagaaagctgatcccatctccagtgtcaaagcttctcagcaccaagttctccagcccccagggtgacacttttccccaggggtcctccccaagccctgtctctgacagggtttctgtctctctcaggggttgttgatgagttgattccaagacatttctcatcccagccttaccactgtctggctgaaaggctctgatgtcagttgggttggaaaattctactgcaatgcttacttcttttcaaggatttcttctgcttcacctttgggtctagaagcaaggaatgaagggagggagagagggagggagggaggggaggagggaagaaaaaagaagtagagataggtctacagacttgctccaattcagtcccacatttcaaaatccagaaaactatgtcatagctgggacagagaggtatcccatttattcagctgtcccatccatcttcatggaacaagcaaagccacatcaataggcaagttcacgtagcagataaaagaggcttctggggctggaacctagatgccatgatttctagcccaaccaggctggtggcctctaccatacatagaagtaccatccacccttacagtaaaagcctccctcctgctcacaaaggaagcctaaagcccaagatttccctctccttgttttattcatttttgcacatctctgttgctctaacagaaatgaactggaatctgcacaggttctctcctgccctgaaagttctgcctggtttccttggcctctgatggcattgaagctttcacaatccctcctgcatctccaccttccctgtcttgctccaggctcctggctccatgccttcctgtgtcaaaaaggctttgccaagaattacttcacctcctaaccaggcttctgccctcagggctcccccagtgtcttgggagtgtcttgggccacacgactgcctcttagaaagttccaaccttgcccccaattcaaatttctcctcccctctttccactctccctcccagaaactcctgatttccagaaaacctcagatttccaggccaggtcactcattccttcctctcatctccctcttcctccatctaccttcctccattcaccttcctccattcctaatttcttttccctggtcttgctataatctccagctctaaaaatcagagctctcaatgaaaacaatggaagaataagacattctttcggtcttctgtttgcctcactggtgtatccttcatctcctgcccctgtgagttgataccccagtgcacggagccaagggcttttcccctctgagctctgggagggaagggaatggagctctgggtttgagatgtcatggcctgtgatagtcagtttggttcctgccactagcaagtcccctgaagctcccaacccagcctgatgttagcccagaagctcctgctctggccaaagactcctatccttgagggctctcagccactgctccaacacacttgcccccttcctgcttgtgtatgtcacttatcctcctttgtccacaaagacttgagggcctcctgagtctccaagcatggaggaatatccatgccaacatccctgccatcaaactcaatccattttcttcagagataccttgtctgtcaccagcctccaacttcatattccttccacaggcaactgtgcacttgacccaaggtaaaatgaaagggctgccaatcactcggactccagaaggtgcctgccctgagaagagctggcatgttacctcccacatacatttcctgtcatcctgtccgaatctgggaaattttgctctggagtattttcaagaaagcgcattgtgttttaatgaagtatttttcagggttccaatgttattttttataaatgcagcattttaatggcagattcaatatgaaggacatgtcttcctgggctctatatttgattttggaaggcagcatactctaggagaaaaaaagcatagggctgaggctctgaagacacagcttccagccctggctttgtctccgagggggagtcatgttccccactcagtgcctcagtttccccatctgtaaaatgaggggctttgactagatgagctctgaagtttcatccagctcttacactgtagggctttcattccctgccagcacctgctctccccgttcctccccacctccactgagctgcacacatcccacaatgcctgccccacagcgatgtcctcagatgtcctggacagccaccgcactcctcactagagcctggggtgggcctgatgggctcggccacccagggatgccctcgtacctgaagtttaagggcctaaccattcaataggtcaccaactgtgtgccatggaagccctcttgtaaagacacacctaaaccatcctaagtgactgtggaattctggggaattctgagtttggagtttccatttggatacggtccttatagctggagggaggcggttccaatttcagagagggagctggctggagagaaaggtctggaggttggcccataagggcatgaagtttgtacttgagggcagctgggaaattcatttcaagctgcagaggaacgtgttcacaggctgttgtgtggcaatgaatgtcatgataacccactctggaatatgtgtcctgaagaccaagtctggacactgaggctccattccaactggaggaggaggcatctccatctgggctgctaggaaggggcactcatcccatcctagtacctttgtagcccttcgtcatgacactaccgtcctcccggtgaaggcttgtgaagcaagaatggagagtccaagtttgtgatattcaaacccatcttgtaaatcagcaaacacattaaccttccatcagtcagagaaataatgttgtggctgtgtgtttccttaatgctctccctcctgagggaggagaagaccctgctcaactttgctgcccaccctgcagtgacccctgaatgccacaccatgggaggactcattcattggctttgtagtggcaaatattcctctagttctataactcaactagacattttgtagtaaagaattcttgaaattctctaataaaaagcaattcttactgtaatatttttagtttggggacacaatttcctaaggggggattaatgaacatttttatgcattagcccaatttatgaattccatgtttattatatggtagtactgatgaaaagtacctttctatctgtatctttgcagtttcttcgttactcatatgtaagcctcatggtaagcagtgctctagtaactgcttctctgtacaaatctcatcgttctacttacctgtcaaagcacattctacatgtactgtaaacagatacactttagtaagatttagtcttaaggatttttccacttttgtcagtaacagatatttatggattaaaaaataaagccgtttcaacataa

SEQ ID NO: 19048 - DNA, 7262 bp, Homo sapiens
  ENST00000409168
atggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtgaccggcggggcagggccggggctgctgggcgtggcagagcagagcgggggccgggaggggccaggagcagagcttctagccttgccactctcccttcccttgtcccctctgtaggaagtgggggtgggccacctttgcccaaaaagccatacccccggggacacagccccgatggcctggtccaatacacttagacccaggaccaagagcaatcgctcttgctcctccagaagaatcagtggggagtgaggagggggctaggccccattctcacccccgaccaccttcaccaactccctttccgtcccgcgcctccttctccccatccgggggactcagctgcaggttctgtcagcagagagacccttgcttgactgtggtctgaagctgcctgggtttgaaggggccagcgggtccaatcagtgggctgaccggataggctactcggtctcattcattcatctagaaccgcatcacagaaatctcctagtgcctaaaaactgcctgctcgctctctcagagccagggagctgctgtgtccataagcacaataatgattcttttcttgcctgctggaactctctggtccccactgagtgacccttcctttgctgacccctgagggcccaaccctggccctgtgcccctcccctcaactccaggaccaggaggggttcccttccttcagctgcctccccattggtgggaactccacccccttccagctgactgcccgcccataaggaccctgggcctgtcctttcagcgggctgtgctccttccctggccctgaggatttcacccttgagttttctggggttttggctgtagccttcgcagaggggagtagcaatggggtgctggccctcccagacacccgatcatctccgcactccctccaggcctctagacctgaccatgactgccactcaggctgccttctccacccctgctctgctcccaggaggcacctgcggtggccagagagccagggtggggagggccactgtgatgtgcggggtctcgggctcaacattcgcatcctgcagggctccacctgttcccacatgcacctccggcaggacctagacagaagtttctagagagcagcttttcagcccccagacaaggaggatgagaggtggttgtcctgcatcctctccgctcatccttccttccccatctctgtctacctgctcagttcagagatcactcctactgcctgtgtccccttcccccacatcctccctgcaactttattcctcctagctgatccttcagatccgtgcctcctctggatcaaagggacaaagacctattagcaaaagcaaacaaaggtcctccaggcgactggcctaggggctaactgggcaggtccccacagcatcatccctttgtgcaggcactggggtacctggtagaccatggtcctcagctctgttgggggaccgccactgcccgcccacctcagcctcttccccgcctccagcctgggggttggcatggtgtgacggcctcctggggaggtgacagtgaattcagcagcatccgctcccccaagaccagagagcctggtgggggaaagaaggggttccctcattctcagggccagggcacccgctgggttggggctgggggaatcaactccaggctattgggtgaaggtgtgatcctaaaaacagtcagatccaacagcagtgcccttataaatggggttttacctgccctcagttctgcactcatggccctttaaaaaggcgagtgtagaaggagaatttattggtgtcagccctggagatttttaatctaaccaagtccacaaaccacagagaaagcaatggactgtgtcctttcactgatttcaagagttccaaagctctcatctccttctcccctctgcagggtgtgcctcccaacaggaacaggaaaccatcaccctggatcttagggggatggaggctgggggttgtgaaagccactgtcagaccccacactggggatgcattcctggagtcgtgcggctggaaggccagggactaccctctctgctttcctcccaacagacacataaaccttcttaagggctggtccccaggggtttataagagtttgttccagaaggtgaggctaagagggttggaaaggaagaagtgagtctgaatagagcaggtggctcccagctgggcccctgagcccagcacctttgaatcgtctaatctgtggccatcccttggaaggcaggatgctggtggtgaggggaaaggacctgagtggctgagaatgcccttcccaggtgtctacatgcaggtatacaccaaaccagaaagctgatcccatctccagtgtcaaagcttctcagcaccaagttctccagcccccagggtgacacttttccccaggggtcctccccaagccctgtctctgacagggtttctgtctctctcaggggttgttgatgagttgattccaagacatttctcatcccagccttaccactgtctggctgaaaggctctgatgtcagttgggttggaaaattctactgcaatgcttacttcttttcaaggatttcttctgcttcacctttgggtctagaagcaaggaatgaagggagggagagagggagggagggaggggaggagggaagaaaaaagaagtagagataggtctacagacttgctccaattcagtcccacatttcaaaatccagaaaactatgtcatagctgggacagagaggtatcccatttattcagctgtcccatccatcttcatggaacaagcaaagccacatcaataggcaagttcacgtagcagataaaagaggcttctggggctggaacctagatgccatgatttctagcccaaccaggctggtggcctctaccatacatagaagtaccatccacccttacagtaaaagcctccctcctgctcacaaaggaagcctaaagcccaagatttccctctccttgttttattcatttttgcacatctctgttgctctaacagaaatgaactggaatctgcacaggttctctcctgccctgaaagttctgcctggtttccttggcctctgatggcattgaagctttcacaatccctcctgcatctccaccttccctgtcttgctccaggctcctggctccatgccttcctgtgtcaaaaaggctttgccaagaattacttcacctcctaaccaggcttctgccctcagggctcccccagtgtcttgggagtgtcttgggccacacgactgcctcttagaaagttccaaccttgcccccaattcaaatttctcctcccctctttccactctccctcccagaaactcctgatttccagaaaacctcagatttccaggccaggtcactcattccttcctctcatctccctcttcctccatctaccttcctccattcaccttcctccattcctaatttcttttccctggtcttgctataatctccagctctaaaaatcagagctctcaatgaaaacaatggaagaataagacattctttcggtcttctgtttgcctcactggtgtatccttcatctcctgcccctgtgagttgataccccagtgcacggagccaagggcttttcccctctgagctctgggagggaagggaatggagctctgggtttgagatgtcatggcctgtgatagtcagtttggttcctgccactagcaagtcccctgaagctcccaacccagcctgatgttagcccagaagctcctgctctggccaaagactcctatccttgagggctctcagccactgctccaacacacttgcccccttcctgcttgtgtatgtcacttatcctcctttgtccacaaagacttgagggcctcctgagtctccaagcatggaggaatatccatgccaacatccctgccatcaaactcaatccattttcttcagagataccttgtctgtcaccagcctccaacttcatattccttccacaggcaactgtgcacttgacccaaggtaaaatgaaagggctgccaatcactcggactccagaaggtgcctgccctgagaagagctggcatgttacctcccacatacatttcctgtcatcctgtccgaatctgggaaattttgctctggagtattttcaagaaagcgcattgtgttttaatgaagtatttttcagggttccaatgttattttttataaatgcagcattttaatggcagattcaatatgaaggacatgtcttcctgggctctatatttgattttggaaggcagcatactctaggagaaaaaaagcatagggctgaggctctgaagacacagcttccagccctggctttgtctccgagggggagtcatgttccccactcagtgcctcagtttccccatctgtaaaatgaggggctttgactagatgagctctgaagtttcatccagctcttacactgtagggctttcattccctgccagcacctgctctccccgttcctccccacctccactgagctgcacacatcccacaatgcctgccccacagcgatgtcctcagatgtcctggacagccaccgcactcctcactagagcctggggtgggcctgatgggctcggccacccagggatgccctcgtacctgaagtttaagggcctaaccattcaataggtcaccaactgtgtgccatggaagccctcttgtaaagacacacctaaaccatcctaagtgactgtggaattctggggaattctgagtttggagtttccatttggatacggtccttatagctggagggaggcggttccaatttcagagagggagctggctggagagaaaggtctggaggttggcccataagggcatgaagtttgtacttgagggcagctgggaaattcatttcaagctgcagaggaacgtgttcacaggctgttgtgtggcaatgaatgtcatgataacccactctggaatatgtgtcctgaagaccaagtctggacactgaggctccattccaactggaggaggaggcatctccatctgggctgctaggaaggggcactcatcccatcctagtacctttgtagcccttcgtcatgacactaccgtcctcccggtgaaggcttgtgaagcaagaatggagagtccaagtttgtgatattcaaacccatcttgtaaatcagcaaacacattaaccttccatcagtcagagaaataatgttgtggctgtgtgtttccttaatgctctccctcctgagggaggagaagaccctgctcaactttgctgcccaccctgcagtgacccctgaatgccacaccatgggaggactcattcattggctttgtagtggcaaatattcctctagttctataactcaactagacattttgtagtaaagaattcttgaaattctctaataaaaagcaattcttactgtaatatttttagtttggggacacaatttcctaaggggggattaatgaacatttttatgcattagcccaatttatgaattccatgtttattatatggtagtactgatgaaaagtacctttctatctgtatctttgcagtttcttcgttactcatatgtaagcctcatggtaagcagtgctctagtaactgcttctctgtacaaatctcatcgttctacttacctgtcaaagcacattctacatgtactgtaaacagatacactttagtaagatttagtcttaaggatttttccacttttgtcagtaacagatatttatggattaaaaaataaagccgtttcaacataa

SEQ ID NO: 19049 - DNA, 1329 bp, Homo sapiens
  ENST00000343478
gaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagggcattatgggaaggatgcttaccgaagtggaggacctgatctccataacttcatctcatctggatttgtcacattaggaagaggacacaccaagggtacagtggaaaccattttttactaaaatacagaggttgcctagggaacgccatctgaaatgagaagatggtgtggaggccagaggcttgtctgggacaggaataagtggggtggttccatggcagcttgtcctggtgacatgcgtggcttctgacaggagttactggaggtcacaggtgtgactttagagggcgatagacttccaagagacacccatcccactccacccatggcggggacacagatgccggcggctccttgtgggaagggaccacagggagtgtggtggaaaactgccggtggatgtagcagcatttgcaatgtgtgtgttcgcctcttggctattattccttttccttttgaaagctacattttataaaccaatgtcaatgttctgtactgtggtatctaagccggtgtgcatgtggagagtttcagcatcctaagtgtgtctccataaacactctatgatgtggacacaaaggtagaaggttatgcagaccttcaagcctcaagatgaaagctaacctagagtttctgctgagctgctttacaacctagctgacagcttgcagagcatctgtgcagggggcatggactcctcctcaattctgtcttttgtttaaacaaggtcctacgagtgttgtgagcattctgtcacatcaagagtcactggatccctaactcctttaattaccgtcccaacacctgtgtgctgttatagatcaaatgtgaattctgttgtaggggtagtgtatccctgtcttcccctgagatacgtgtcttgtgtgagtaaacaaggaactgtgcaatattttcttacattccatgcacctactttttaaattccttatgtgatgtttgttcatcctatagagaaaaaaaaatctgtatctgtgtatgtattttctgttgtgtctatttgtgtctaaataaagtttatcgaggata

SEQ ID NO: 19050 - DNA, 6033 bp, Homo sapiens
  ENST00000376325
atgccggccctcctgctcctcgtactcctggcctctagcgccggccaggccagggcgcgcccgtccaacgccacgagcgccgagcccgcgggcccgctgcccgccctgctggcgcacctgcggcgcctgaccggggcgctgacgggcggcgggggcgcggcgagcccaggcgccaacggcaccaggaccggccccgcgggcggggcgggcgcggcggcccgggcgccccctcccgccgagctctgccacggctactacgatgtcatgggccagtacgacgccaccttcaactgcagcaccggctcctaccgcttctgctgtggcacctgccactaccgcttctgctgtgagcaccgtcacatgcgcctggcgcaggcctcctgctccaactacgacacgccgcgctgggccaccacgccgccgccgctagctgggggcgccgggggcgctgggggtgcgggcggggggccagggcccggccaggccgggtggttggaagggggccggactgggggtgccgggggccgcgggggcgagggccccgggggcagcacagcctacgtcgtgtgcggggtcatcagcttcgccctggccgtgggcgtcggcgccaaagtggccttcagcaaggcgtcccgtgcgccccgggcgcaccgggatatcaacgtgcccagagctctggtggacattctgagacatcaggcggggcctgggacccgcccggaccgggcccgaagcagctccctgaccccggggatcggcggtcccgacagcatgccccccaggacgcccaagaacctctacaacaccgtgaagacccccaacctcgactggcgagccttgccgccgcccagcccctccttgcactactccacgctgtcctgctctcggtccttccacaacctctcgcatctgcccccgtcctacgaggctgccgtgaaatccgagctgaaccgctactcttccctcaagaggctggccgagaaggatctggacgaggcctacctgaagcgccggcccctggaattgccccgcggcacgctgcccctgcacgcgctgcggcggccgggcacggggggcggctatcgcatggaggcctggggcggcccagaggagctgggcctggcgcccgcgcccaacccccggcgggtcatgtcccaggagcacctgctgggcgatggtggccgttcgcgctacgagttcacgctgccgcgcgcgcgcctggtgtcgcaggagcacctgctgctgtcctcgcccgaggccctgcgccagagtcgcgagcacctgctgtcgcccccgcgcagccccgcgctgccccccgaccccaccgcccgggccagcctggccgcctcgcactccaacctgctgctggggcccggggggcccccaacaccgctgcgcgggctgccgccaccgtccagcctgcacgcccaccaccaccacgccctgcacggctcgccgcagccggcctggatgtccgacgccggcgggggcgggggcacactggcccgcaggccgcccttccagcgccagggcacgctggagcagctgcagttcatcccgggccaccacctgccccagcacctgcgcacggccagcaagaacgaggtgactgtctgaggccagggccgggtctggggggctgcggcctcccgggccccccgtcccagcctggatcccccgacacaggcgcacacatgccaggggcctggggcccagatcggcccttggacaggagtgaaagcctccttctgggatgtcctggcagacaagattcctcctcctattacttcactgcttgagccaaggcctccttcccatgatgtcatcccagaggaagaggccggctcatgaggtcatcactagcaaaaatgtctgtgttctgtgatgtcatcacagggacaaagcctcgttcccatgaggtcatcacagaggaagaggccggcccgtgaggtcagcgctggaggccatgtccatgttctatggtgtcctcagaggcttccttcttgtggtataataacagagacgacgccttgttccatgacattccttcctgtggtgtcactgcagagacaatctcacctggatgatgtcatctctaactccaaggcctcttttggcatcatcgccatggggaagatattttctccctgtgtctttgcagcagagaagatgcctctgtcctatgatgtcatcattacagacaaagccatcttcctgggacacgtcgcaggggaaaatgcctcaccgattgtgtcctcactagacataaggtccccttttcacaacatcatcacagggaccctgcctccttcctgtgatgccatcaccagagaaggtgccttgccctatgacgtcatcagagggaccgtgcctcttcctgtgatgtcatcaccagagatgaccacccactctgggacctctccaggaggaggtcccttctgtgatgtcgcccagatgctatgtgctctgagatggcacaaagagatgcctccactgctgccaccatgttgtagaaggcagggcaggcccagagtccaggaccaccccagggaagatgccagagagcagagaggggccctgtcctgagatgttgtctgaaggaagcatcgctggggagccgcccatgtggagggcctcctccagagatgatggtctgtgtaggctgttggcagtgacacccctacccccaatgctgtgatggcatcaccagagcttcctcctcagaggcactgcccactctggaaggccatcggtattggtggtgtcaccagagttactgccttgtcccaccatgacttagcttggttgctccctccccagactccagggacatgtccagcaggatctctgccagaccctctgaggggaaatggggccttggatcccacatctgtgccatgactcctgggagacaggacctccagatggccttctgctcccaggaggccactctggatcaccaggatcctggagttctggcactcataggtgtcccatagcctggcctcacttttctttctgccatatctagagacaatcacctctgtcaacaaagtcctagccttctactggggggaggtgcttggggtacacctactcttgccctcactgacactgtcagcatcacacaacacccgccactcatgatggcaccacacccggggtcaagtgttacccatgtctgaggatggaatccttccccaggattacctatgacccacaactatggtatcatcttcttccaggatttaccatgactaatggtgtcaccatctgccaagactccccatagccaatggtgtcaccatcctccatgattcctcacaaccatggtgtcatcatctttcaggagccaccacagctgacggtgtcatcatctcctagattccaccatgaccagtgatgacattaccttccagaatccactacacctgacagagacatcctctactgaaatccactaggactgatgattccaccatttcccataatccctcatgattttggtgtcatcacctcccaagacccatgatgcccaatagtgtcatcatcatttgcagggatgcatggtgtcatcatctccagggatccacttcaaccatgtgccaccacctcccaggatttcattcaaacatgtgccactacctcccagtatccacttcaactatggtgttatcacctgccaggatccacgagagccaatgctgtcaccatccactaggatccaccataaccctggtgtcatcatctcctgtgatccatgaggtccagtgctgtcaccatccactaggatccaccatgaccctggtgtcatcatctcctgtgatccatgaggtccagtgctgtcaccatccactaggatccaccataaccctggtgtcatcatctcccaggatccatgaggtccagtgctgtctgtcaccatccactagtatccaccataaccctggtgtcatcttctcccaggatccatgaggtccagtgctgtcaccatccactaggatccgccataaccctggtgtcatcatccgtgatccatgaggtccagtgctgtcaccatccactaggatccaccataaccctggtgtcatcatctcccaggatccatgaggtccagtgttgtcaccatctactaggatccaccatgaccctggtgttatcatctcccaggatccatgaggtccagtgttgtcaccatctattaggatccaccatgaccctggtgttatcatctcccaggatccatgaggtccagtgctgtcaccacccactaggatccaccataaccctggtgtcatcccagagtccactgcaaccatgtgccatcatcccccaagagccatcatcttaggagccaagtaccgtgacgggctgtatttcagttgtcctctggggccgcatggtacttacagttgttcacttaaggggaaccagcacaacaggccatattcccgtttccactaaaaggacaggggtggggccagctgtccccctctgaagacttcacccctactctggccctccttatgtcactgcctcactcctgaccgaggatgatgcctgcatcaatcccaccacagatgtggcctcagccaacctcaccttaccccccggtgaggcacccaggcccctcctgacagcagcgctgtccctcacccagccatctgattggtgacagggtcaacccagcaacctctcattatcaccagagaggaagcatttcaaccctcaggtgacgccactgccccctgcccaatccctgtcacttgggcccctaccaggatcagcactccactggccccggccaaattctcctcagagatccctgacccccgcgggataggtcaaagctggtgaccgactggggccttcagtgctgtcttctgctggcctcatcctgcagcagggacactggagagcaatggtccctgccagcacatctgcgggaccaggggtgctccttcacctccctccctaacaccttaacacccggggagcctccgggggtggcaggaagtccccagcacccaatgcacaatcttccctcaattctctttgtacatagccatgttgcgggggcggccattcccccactcttaaagggctacacgcccctcccccagcccctagggcgaggtggggggggcctcttcttcctcccctgggccgtccccctccctcttatgtctccccgcaaacactggcacctcacactccttcttgtcaggagcttggggcagacaactggcccttggttcccaccacactgaggaaatgggggttacccaaatccacctgggccctggtgccagtttttcaaccccacggcttctagctgctctgaggggctcctcccatcccttccagggcctccccagccccgcactgctcaggccaactgtgacttccccagaaaggagccagcttgagcacccaccccctcccagccccctcccctctgctcaacacctccgcggaacactcagctttctccagctgccgggatttgggggtctgggcctttcagcttttttatcccccctccactagctctagcccagcctggattccagggatcccacccctagccctgtccctattcagttggcacaggctgcctgaccctggggccttgatttgatctcaaataagccatagaggagagaggtcttgaggggtgggagcaggtgtgtactgacaattcccctccacatgtcttgagctgggacctcgtcatctgagacttccccatgccccaacaaatgcaaatgcacacaaacccatgcatacacaagcacacacacacaggcatctccccgtctggttgggggagcatgggagggggcacttcacagggagaagataaatagttccacacctgaagaccctccaacagcttctgcctccctcctcatcacttcctctctccaccccctctccaacactggccccttcccctaattaattccctggtgaggacagccagaggagctgcgacttggtattttttggaataaatagacattttcctga

SEQ ID NO: 19051 - DNA, 2321 bp, Homo sapiens
  ENST00000416792
gcgggggcgagggccccgggggcagcacagcctacgtcgtgtgcggggtcatcagcttcgccctggccgtgggcgtcggcgccaaagtggccttcagcaaggcgtcccgtgcgccccgggcgcaccgggatatcaacgtgcccagagctctggtggacattctgagacatcaggcggggcctgggacccgcccggaccgggcccgaagcagctccctgaccccggggatcggcggtcccgacagcatgccccccaggacgcccaagaacctctacaacaccgtgaagacccccaacctcgctacctgcacctcaacgtcaacagccccaagcaccacgccgccacactggactggcgagccttgccgccgcccagcccctccttgcactactccacgctgtcctgctctcggtccttccacaacctctcgcatctgcccccgtcctacgaggctgccgtgaaatccgagctgaaccgctactcttccctcaagaggctggccgagaaggatctggacgaggcctacctgaagcgccggcccctggaattgccccgcggcacgctgcccctgcacgcgctgcggcggccgggcacggggggcggctatcgcatggaggcctggggcggcccagaggagctgggcctggcgcccgcgcccaacccccggcgggtcatgtcccaggagcacctgctgggcgatggtggccgttcgcgctacgagttcacgctgccgcgcgcgcgcctggtgtcgcaggagcacctgctgctgtcctcgcccgaggccctgcgccagagtcgcgagcacctgctgtcgcccccgcgcagccccgcgctgccccccgaccccaccgcccgggccagcctggccgcctcgcactccaacctgctgctggggcccggggggcccccaacaccgctgcgcgggctgccgccaccgtccagcctgcacgcccaccaccaccacgccctgcacggctcgccgcagccggcctggatgtccgacgccggcgggggcgggggcacactggcccgcaggccgcccttccagcgccagggcacgctggagcagctgcagttcatcccgggccaccacctgccccagcacctgcgcacggccagcaagaacgaggtgactgtctgaggccagggccgggtctggggggctgcggcctcccgggccccccgtcccagcctggatcccccgacacaggcgcacacatgccaggggcctggggcccagatcggcccttggacaggagtgaaagcctccttctgggatgtcctggcagacaagattcctcctcctattacttcactgcttgagccaaggcctccttcccatgatgtcatcccagaggaagaggccggctcatgaggtcatcactagcaaaaatgtctgtgttctgtgatgtcatcacagggacaaagcctcgttcccatgaggtcatcacagaggaagaggccggcccgtgaggtcagcgctggaggccatgtccatgttctatggtgtcctcagaggcttccttcttgtggtataataacagagacgacgccttgttccatgacattccttcctgtggtgtcactgcagagacaatctcacctggatgatgtcatctctaactccaaggcctcttttggcatcatcgccatggggaagatattttctccctgtgtctttgcagcagagaagatgcctctgtcctatgatgtcatcattacagacaaagccatcttcctgggacacgtcgcaggggaaaatgcctcaccgattgtgtcctcactagacataaggtccccttttcacaacatcatcacagggaccctgcctccttcctgtgatgccatcaccagagaaggtgccttgccctatgacgtcatcagagggaccgtgcctcttcctgtgatgtcatcaccagagatgaccacccactctgggacctctccaggaggaggtcccttctgtgatgtcgcccagatgctatgtgctctgagatggcacaaagagatgcctccactgctgccaccatgttgtagaaggcagggcaggcccagagtccaggaccaccccagggaagatgccagagagcagagaggggccctgtcctgagatgttgtctgaaggaagcatcgctggggagccgcccatgtggagggcctcctccagagatgatggtctgtgtaggctgttggcagtgacacccctacccccaatgctgtgatggcatcaccagagcttcctcctcagaggcactgcccactctggaaggccatcggtattggtggtgtcaccagagttactgccttgtcccaccatgact

SEQ ID NO: 19052 - DNA, 486 bp, Homo sapiens
  ENST00000457093
gtcgggccgcgcgggagcccccgaggcgcagggtcccgcggcgcccggcacgacagccccggaggggggcgaccgctgccgcggctactacgacgtgatgggccagtgggacccgcccttcaactgcagctccggagcctacagcttctgctgcggcacgtgcggctaccgcttctgctgccacgacgggccgcggcgcctcgaccagagccgctgttccaactacgacacgccggcctgggtccagacaggccggccgcccgcccgcgcccgcgacaccgcagcgccccgggaccccggccgcgagcgcagccatacggccgtctacgctgtgtgcggcgtcgcagcgctgctggtgctggccggcatcggggcgcgcctgggactggagagggcgcacagcccgcgcgcgcggcgcacagtgaccagggcgctgacagagcttctgaagcagccgggcccccaggagccactgcctcccaccct

SEQ ID NO: 19053 - DNA, 1405 bp, Homo sapiens
  ENST00000621082
atggcgcgggccggggcgcggggactgctcggcggccgccgtcctcccggcctccggctcgcgctcgcgcttcggctcgcgttgctgctggcgcggccgccgtcgggccgcgcgggagcccccgaggcgcagggtcccgcggcgcccggcacgacagccccggaggggggcgaccgctgccgcggctactacgacgtgatgggccagtgggacccgcccttcaactgcagctccggagcctacagcttctgctgcggcacgtgcggctaccgcttctgctgccacgacgggccgcggcgcctcgaccagagccgctgttccaactacgacacgccggcctgggtccagacaggccggccgcccgcccgcgcccgcgacaccgcagcgccccgggaccccggccgcgagcgcagccatacggccgtctacgctgtgtgcggcgtcgcagcgctgctggtgctggccggcatcggggcgcgcctgggactggagagggcgcacagcccgcgcgcgcggcgcacagtgaccagggcgctgacagagcttctgaagcagccgggcccccaggagccactgcctcccaccctgggcccacccctgggtggctgtgtccaggtgcagatgggggacggcctcccccggggctccccccacaacagcgcagacaagaagcgcctcaacaacgcgccccgggggtcggccgccccggggcccccgcgcggcccgcggctgcagggcggcggcagcctgacgctgcagccagactacgccaagtacgccacgttcaaggccgccgcgctcaaggccgcagaggccgccccgcgggacttctgtcagcgtttccccgccctcgagccgtccccgcggcaacccccggcgcgggctccgcgaccatccccggacttgcctgcgccgctggacgcctgcccctgggccccgccggtctacgcgccccctgccgcgccgggcccctatgccgcctggacctccagtcgcccggcccggcccgccccgctcagccacccgacggctcgggccttccaggtaccccggcgacccgggcacgcggcccggcgccagttcagtgtgaagatgcctgagaccttcaacccgcagctccccggcctttacggcagcgcgggccgcgggtcccggtacctaaggaccaatagcaagaccgaggtcaccgtgtgaagcggggccgcggtgccctcgaggcatgggctggggtcctgtctgcccgtcggagcctcaggccacagggagaggagcgcctgccgtaaggccagctcttctgtctgcctcaacggcagtggtgtcttggagcctgcaggccgcgggttcgtcttgtaaataagcccttttatgtggttcctgcccctgagaataaagaagccccagcgtg

SEQ ID NO: 19054 - DNA, 7447 bp, Homo sapiens
  ENST00000380913
tctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggaggagcgagctgggctggaggcctcactcctggcatgccaccaagttctctgacagccaccccgagctagcggcctccccattcacctccaccagcggctgtccttcctggtccggccgacaccacgcgagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggaagcttctgtcgaactgcgaaggcaggcaggggaccccggcgagcccagagaagagcttccctccgcagtccgggccgaggagggacagtccacgccgagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaa

SEQ ID NO: 19055 - DNA, 855 bp, Homo sapiens
  ENST00000493668
aaggcagcttgaggacttggtgtctcattatgttgccctttgcaggaagcttctgtcgaactgcgaaggcaggcaggggaccccggcgagcccagagaagagcttccctccgcagtccgggccgaggagggacagtccacgccgagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtg

SEQ ID NO: 19056 - DNA, 2276 bp, Homo sapiens
  ENST00000452575
gtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatgacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagca

SEQ ID NO: 19057 - DNA, 4615 bp, Homo sapiens
  ENST00000418909
atcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacgacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcggcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtg

SEQ ID NO: 19058 - DNA, 11020 bp, Homo sapiens
  ENST00000296043
gttattaactgtaagactgtttgaattgtcaggtctttgtggtgagctgaattctgcatggcagtgcttactgtgcagaaaggttgcaatgcctcactttgccttaatccatgttcctctaacttccttactctttctctcaagaggaggcaagtggctgtggcggccgcagcagtggctgatcatcactgaaaataccaaagaaaagaactgagctgcctccttcatattttttccattgaggattaatttaccgtgctttttcattttctctacatcctgcaaaagtttttttctctcctaagaaacaaactatgaactgattgttgaaaaaaagaagtaaaaagttttagcacagcttctctgtctcttcgggacaagttagaaaattctgaagtgagccgaagcatagtaagtgctttctttctttttaagctacttctggggagggaggaggctattgtaatggtaaatttcactccgagaggaagaaagggttgataatcaatcaaaaatgaggtattcctttgagtatttgtgattttcttactatattgtaagatgcttttaattttctctgtaaaataggcagaaatggttttagtgtgtgtatgtgtgaaataaaagctcagaaaagcaatcttcagagcgccactgaaggaagttttgacgaacggagtagagatgtataccacttgggggcttcagtgagaacccagaattcctggaggaggatttacattcagaaatgttgaagtgaaaattccttctggttcagcatcttggagttcagcttggaagaacattttacgtatggaagaatttgcttctccaaacctctcttttggccattgtgtgtcctgaaggatgggacaacttgtgctgtagaagcactgcttgcctgagtttgcttcaggcattttaaatttaacttgagggatcatgtgtttggcatgatgaggaccactgaagacttccacaagcctagtgccacattaaactctaacacggccaccaagggaaggtacatttatctggaggcattcctggagggaggagctccctggggttttactctaaagggtggcctggagcacggagaaccattaatcatctctaaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagagatgtgtgcacagacccaggccatgcagatactggtgcctctaacttcgtcagcccagaacacctcacctctggcccccagcacaggaaagcagcgtggtcaggaggggttaaacttcggctgaagcacaggcgcagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccacaccctggcatctctggccgggagcgttcaggctccatggacaatacttctgctcgaggtggcctcctcgaagggatgaggcaggcagatattcgctatgtcaagacagtctatgacacccggaggggagtctcagcagagtatgaggtgaactcttcagccctgctgcttcaaggtagggaggcccgagcctcagcaaatggtcagggctatgataaatggtctaatattcctcggggcaagggagtgccacccccatcctggagccagcagtgccccagttccttggagactgccacggacaaccttcctcctaaggtgggtgcacccctgcctccagctcggagtgacagttacgcagcatttcggcaccgtgagcggcccagctcctggtctagccttgatcagaaacggctctgccggcctcaggcaaactctttaggctccctgaagtctccattcatagaggagcagctgcatactgtgctggagaagagtccagagaacagccccccagtgaagcccaagcataactatacccagaaggcccaacctggccaacctctgctgccgaccagcatctacccggtaccttccctggagccacactttgcccaggtgcctcagccttctgtgagtagcaacggtatgctctaccctgcactggccaaggagagtggatacatagcccctcagggagcatgcaacaagatggctaccattgatgagaatgggaaccagaatggatctggcaggcctgggtttgccttctgccagcccttagaacatgacttgctgtccccagtggagaagaaaccagaagctacagccaagtatgtcccctccaaagtccatttctgttcagtgcctgaaaatgaggaggatgcctccctgaagagacatctcacacctccccaaggcaacagcccacattccaatgagagaaagagcacccacagtaacaaaccatcttctcatccccacagcctcaaatgccctcaggctcaggcctggcaagcgggtgaagacaagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggatgtgcttttggggcaagacagtggctttggtcttgtgaaggatccatgttatttggctggtcctggatctaggtcactcagttgttcagaaagaggccaagaagagatgctgccgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcctgcgggactccccgccacctcatgaggattatgaagacgaagtgtttgtgagggatccgcaccccaaggccacgtccagccccacatttgaacctcttcccccacccccacctcctccaccgagtcaggaaaccccggtgtatagcatggatgacttccctccacctcctccccacactgtatgtgaggcgcagctggacagtgaggatcccgaggggccacgccccagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaaggagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagatagtcacgttgagcgtgaagactttttttcttacattcctgtcttatttttaccaacacgagcaggcattctgcgcttccactggactgagtatgggggagtcctgctcccctcctgtctcacaccttccccaggaggaaggcctcatgcactgcggttattgcatcatttcctagtgcttcatgtcattatcactggtggggaaacaaagctaaattttattaacaaagacaactctcagacctatataataggaggaggacgtccagaatccaacaaaattcaaacggagcccatgctgttctcctgaacaagatttgggctaaatacggcctgtttattgaggctgttttaatgatgctttaaaaaaaaaaaatgttttctaaaatgtcaaacctgttgaccacactttgattaaaaactgcctccttaacctctgaagactgattttgctttatcatgtttcaataataacatttcagaggttactctgtagccccagttgtaagcttataaaaacaaactggaaggctgaggaggttatgggctggcagccaggctatgtttacagctgctggagatggcagtagccttatactttgagcaggtagtacatcccaggctgtgctagaggtagatttgttttttcacgtttgatctgtggctggtggccacctttgttgatttgggcttacgagtttcatagtagccagtcttagaaaattgggggagtaaaattttgaagtaaaaaaaaaaaaaaaatgacaagggaaccaaatgctccttctccccttagtacattttcattacttaatgaagttttatctcctatgtaagaatatcaaaattgtagtttgggtctccagtagagatgtcttttgattaacttataaacaactggccacccagaagtttcctttgcatagtcaaccaaagctatggctttgttctttggagcttatatactgcatgactccattgatacaaataagacagcaccttggtttcccagggatgttttcattcagaggtcctgtctcccaggaaagcagtagaaccagtgacagcattcaacagccacactgcatggtcatcagtcttaggccaacatgggagcctgaaattaactccatcagtaactacctgtgtgtcttgctgatactgaatgagccctcacaagccaagccaggtggaagacagccagcaaacgtctacagttattcttagtgaaattcctcagaggaatccagggggctcccagttcccaacactcttcgagatgaccatttttcgggatttgactggggaacattttacatattcagtctttctcaaaaatttttatttattttcttgagaaagggtcttactatgttgcccaggctggagtgcagagtggtgcgataacagctcattgcagtctgaacctctgaggctcaagccatcctcccatctcagcctcccaagtagctgggaccacaggtgtgcaccactatgcttggctaattttttgattttttatagagacgggggtctcgctatgttgcccaggctggtttcaaactcctgggctcaagggatccttccgctttggtcccagaagtgctgggattacaggcatgagccacttcacccagccacttttctaatttatagacataaaagtaattgactcccacagcacagtaacaggcaatgctgcttggcatgccacaaacatctgaaagcttgtgacactcctaggattgtgtccattctttcattatgtggaaactttgttctgttatgtgaaatgggtaaggcaccaagtgagactttgaaatctaatttttaggtggatgtgatatttattgtaataggacttgacctctgtactttaaagaaatcactaaccaaattttcaaagtttccttttaaatgcgtttagctagaaatctatgtatttatccctttcctattttgcattcttctcccactatttttaaaaactcatttacagtagaaaccattcttctttctcccaacagtatcctttgccaagaccatgagaacagtaaggagcatgttgttggtcagggtttcagaatacgcgtgatgtcactgagaatgtttgctcacagtcaataattgtctttgtggatgtgataattttggagatacacttctggtcagaactcaggtgagataatcttgcaatactccaaatgcagatactccagccacccgcaaggttccaggaaaggacaatgtcctgcgagaaaatcaggaggcctccacttcctgggccacttgagaagttcctgggcatgtcactacatgttggttgactcagccatttctcatgctgttttgtttcttgcggtggccacttaaccccaaagaatgaagggaggatccacagtgaaagtgcctgagtttctctatgagaccagatgctgtcgaaaccaaacatcttttcctttgctctatgggaacattttagggtttgttttgcacagctggtttccagactagaagattaacaagtttgggtccacccctaagaatcagtggctgtcttttaaggtgaggagtgtgggcttaactgaggtcctttgagggagctataaaggagaaacaacctgggacatcccagttttcctattcctccactgttaatatctcatctaaaataattcatgagtttaaatggtaaatatatgctttaagctctacctttaaacttgtatgttattcaggcatctcttattaagatactgggtctctggatacccaaggaaatgttggctttttattcttatgtggttccaaatttacttctcttcagtttaattgtccatggtagtgctggcttcattgttaggttggagttattattttccttttagaacaacatgaattttattcaccttactattagaaaaaggaataactacagccagaaataacttcatttcctacaaggtataaaaagtggtcaagtgaatgtgaaggggcttttctacacaggaatatattatcgggaacaaagtatttcctgctgccttaactctttgggatgcataggataaaatgataaagaccattttaatatcagaaagggttgtcttattaatttttaaataaaacttcacatttcttaatggggagctcattcagaaactaaataatggtttctcaaagtgtggtcaggatacgatctgcatcagaatccttggaatgcttgttaaaaataccaattgctatgacaaaaccaagtctgctggaaactgcatttcagcaggtttcccatgttattctgatgtattttaacatttgagagccactaccaatcatctgtacagttcctactgttatgatcacaataagactaacatgaatttaataatctgaataatttttaaaatttaaataaacagaaattgaagttaaatttaaaaataaaaataacctcagaagttgaaa

SEQ ID NO: 19059 - DNA, 611 bp, Homo sapiens
  ENST00000497440
caccaagggaaggtacatttatctggaggcattcctggagggaggagctccctggggttttactctaaagggtggcctggagcacggagaaccattaatcatctctaaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagcctctccccaccggtcactgttagcctcgagtttgaccctcaacatccccagaggatgcctcctaggactcgaacctcatttagtgtctctactgctgatggacgccatgagtggagctgtcgaccaccttgggtgaagtggtggtctccacgtcccacctgggcagcacgatggccacagaaaggttgtatctaccccacccagcacaacacatgcagaaatttcaaaagagcctatttaagtagatgagcatagatagataattctgggagaacatccttaaaaggagtttggttttttgtttgctttgtgtgggtttttgtctaaataaactagactgctttaa

SEQ ID NO: 19060 - DNA, 628 bp, Homo sapiens
  ENST00000466541
ctggagggaggagctccctggggttttactctaaagggtggcctggagcacggagaaccattaatcatctctaaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagttgaactttcaaaggaaaaggaggctgcctttacatctgacacatgcttatagatggggattatcaacacgcctccagagacatggatggacattcctcccctaccttgcagagatccgggtagaagcctctttgcgctggattaatctggctttgtatttcgtagtgccgtcactttcctgagaagtcttacctttataccttggcacacgtcatcgtcctgagattctgtttcctttgatttattgatgccagagtgactaaggacatttcatttattaactttctttttttctatgtgatctctatactttaaaaaagactggggtgtcttcctggaaacataataggaaggaatgtctgtttcatgaataaatcatttgtgtagtcaaaatgta

SEQ ID NO: 19061 - DNA, 764 bp, Homo sapiens
  ENST00000469923
agaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagagatgtgtgcacagacccaggccatgcagatactggtgcctctaacttcgtcagcccagaacacctcacctctggcccccagcacaggaaagcagcgtggtcaggaggggttaaacttcggctgaagcacaggcgcagtgagcctgcaggccgacctcactcgtggcacacaactaaatctggggagaagcaacccgatgccagcatgatgcagatatctcagggtatgatcggccctccttggcaccaaagctaccattccaggatgtgcttttggggcaagacagtggctttggtcttgtgaaggatccatgttatttggctggtcctggatctaggtcactcagttgttcagaaagaggccaagaagagatgctgccgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctc

SEQ ID NO: 19062 - DNA, 504 bp, Homo sapiens
  ENST00000490690
acatcagcgggccagctcctgtcaggcaggcggccggcgattggccgggaggaggcagtcattcaaactgccttttgtgtttggctaatcagggcagcccaggttcccagcggaggtgcgtctgtggtgtcagacacctgtgtctcagctctgtcttcctcgggctggctcctgcggatccttcctgggccagaaccgtgcctctaggccacctcccccaagccaccaagcccccgcggtgggccagccttggcccagtgtcacgcaggacagaaatgaccaacagataactgaggacaatggacctgcctgggcatagacttccttaagggtcccgctttgtcacccagcctggaatgcagtggtgcgatcttgactcaccgcagcttggatctcctgggctcaagcgattctcccgtctcagcctcccgaatagctgggactacagcctctccccaccggtcactgttagcctcgagtttgaccctcaacatccccagagga

SEQ ID NO: 19063 - DNA, 554 bp, Homo sapiens
  ENST00000481002
gtgcgtctgtggtgtcagacacctgtgtctcagctctgtcttcctcgggctggctcctgcggatccttcctgggccagaaccgtgcctctaggccacctcccccaagccaccaagcccccgcggtgggccagccttggcccagtgtcacgcaggacagaaatgaccaacagataactgaggacaatggacctgcctgggcatagacttccttaagagatgtgtgcacagacccaggccatgcagatactggtgcctctaacttcgtcagcccagaacacctcacctctggcccccagcacaggaaagcagcgtggtcaggaggggttaaacttcggctgaagcacaggcgcagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggg

SEQ ID NO: 19064 - DNA, 531 bp, Homo sapiens
  ENST00000485780
agctctgtcttcctcgggctggctcctgcggatccttcctgggccagaaccgtgcctctaggccacctcccccaagccaccaagcccccgcggtgggccagccttggcccagtgtcacgcaggacagaaatgaccaacagataactgaggacaatggacctgcctgggcatagacttccttaagcctctccccaccggtcactgttagcctcgagtttgaccctcaacatccccagaggatgcctcctaggactcgaacctcatttagtgtctctactgctgatggacgccatgagtggagctgtcgaccaccttgggtgaagtggtggtctccacgtcccacctgggcagcacgatggccacagaaaggttgtatctaccccacccagcacaacacatgcagaaatttcaaaagagcctatttaagtagatgagcatagatagataattctgggagaacatccttaaaaggagtttggttttttgtttgctttgtgtgggtttttgtctaaataaactagactgctttaa

SEQ ID NO: 19065 - DNA, 475 bp, Homo sapiens
  ENST00000484236
gcggatccttcctgggccagaaccgtgcctctaggccacctcccccaagccaccaagcccccgcggtgggccagccttggcccagtgtcacgcaggacagaaatgaccaacagataactgaggacaatggacctgcctgggcatagacttccttaaggtttgttcgacatgggtgaatcaatgaattgcacttcaacagcaaaattggattgtattgattggttggctcactcttctcatcctttatgtttcagagaaggtcggattataaatgcaagcacctacatttaagcaacagttgagatgcttaagaacgtgcttctgtgtgattctgattaatccttaactatgctctgatttcattttacttgtaaatcaattgacacatacttcagggaccatcctgtcttttctctggggttgctgtcaccgtatttgtaacttgaggatttaataattgaagattgataaaaaa

SEQ ID NO: 19066 - DNA, 3766 bp, Homo sapiens
  ENST00000486758
attgttgagcgcgttgggccccgccggcgatgccgcgcgccgcctcctcggagcggcggcgaagtttgaacttggcgtcggcctggagccccgagcagcccgggggcggcggccgcgaggcgagcggcgatgagatgtgtgcacagacccaggccatgcagatactggtgcctctaacttcgtcagcccagaacacctcacctctggcccccagcacaggaaagcagcgtggtcaggaggggttaaacttcggctgaagcacaggcgcagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccacaccctggcatctctggccgggagcgttcaggctccatggacaatacttctgctcgaggtggcctcctcgaagggatgaggcaggcagatattcgctatgtcaagacagtctatgacacccggaggggagtctcagcagagtatgaggtgaactcttcagccctgctgcttcaaggtagggaggcccgagcctcagcaaatggtcagggctatgataaatggtctaatattcctcggggcaagggagtgccacccccatcctggagccagcagtgccccagttccttggagactgccacggacaaccttcctcctaaggtgggtgcacccctgcctccagctcggagtgacagttacgcagcatttcggcaccgtgagcggcccagctcctggtctagccttgatcagaaacggctctgccggcctcaggcaaactctttaggctccctgaagtctccattcatagaggagcagctgcatactgtgctggagaagagtccagagaacagccccccagtgaagcccaagcataactatacccagaaggcccaacctggccaacctctgctgccgaccagcatctacccggtaccttccctggagccacactttgcccaggtgcctcagccttctgtgagtagcaacggtatgctctaccctgcactggccaaggagagtggatacatagcccctcagggagcatgcaacaagatggctaccattgatgagaatgggaaccagaatggatctggcaggcctgggtttgccttctgccagcccttagaacatgacttgctgtccccagtggagaagaaaccagaagctacagccaagtatgtcccctccaaagtccatttctgttcagtgcctgaaaatgaggaggatgcctccctgaagagacatctcacacctccccaaggcaacagcccacattccaatgagagaaagagcacccacagtaacaaaccatcttctcatccccacagcctcaaatgccctcaggctcaggcctggcaagcgggtgaagacaagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggtacgtgcaaccagcaagtcctggcctcgaactgtcccttcctccctagaagctttagtggggctccccaaccccccacactctcacccgctctcccagttcagttttccttgtgattacagaaaagtagcatttgttttcatgagttgagtttctcaagtgtcccttacctggtttccttataaagatataggtatctagatt

SEQ ID NO: 19067 - DNA, 789 bp, Homo sapiens
  ENST00000473602
aaaccacctcgtttgacagtttgcttcagtgaatccagtttttcccttattaccaaaaccaaattacaggggagtttgtctttataacagttaatataactttcttcctttttgcttagaaaatctgggttttctgagattgggaaataatgctttattgcttcagaggaacatggataaaaaaggaagacacgacactcagtagtggattcgccttcgtagggcagagaactttgttaggtgcaggcttagaaccctgcacttagctgtgctgctttgctctggctccgggagatgtgtgcacagacccaggccatgcagatactggtgcctctaacttcgtcagcccagaacacctcacctctggcccccagcacaggaaagcagcgtggtcaggaggggttaaacttcggctgaagcacaggcgcagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccac

SEQ ID NO: 19068 - DNA, 6261 bp, Homo sapiens
  ENST00000289292
ccgttttcttgtccattacgcgctatccctccgcctctccttctttcttttcttttctttttttcccttctccttttcccccctctctccccctttctccagctccgtgtcatttcctccttgcgctcgctcgctgcctgagcgtctccagccgggagagtaggcggagcagggcggtgcggggtggcgtagagctggagggcgatggtggcggagctgctgggggcggaggcaacgtagccccctcggaaaaggagcccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcatc

SEQ ID NO: 19069 - DNA, 882 bp, Homo sapiens
  ENST00000483955
gcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgcgagaagagggaagttggagagggaaaagttagcccagaaggaaagcattttctgcagatcagcctgaatccaccgtggctaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaa

SEQ ID NO: 19070 - DNA, 8919 bp, Homo sapiens
  ENST00000460112
ctttcatccttccctttgccaccagggtgctggctggttcctggagcagcgtcttcactcctatccagctcttgacactggctttcgttccctaaggctgtggccatatctaggtccatccaggctgatggtcataccttgccttcagtgctactccttcctgttcttagaactggaacctgactgtgcctgagccccttggatcacactcagcatcttgggctgatggtccctcgccccagaaggtcttaactggagggcagatgggtcccagctaagggaggacgctggctggagggtttgtcaacgagagtctgagctagccggataccccgctctctcccaagccatctctccaccctgggcaacttccatggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatccattgtggtagagtagaaagagtccagctttggcattagaatgaactgtgttcaaatcctggttctgccacttattcaatgaacctgggctactagctcaacttctgaggtcattttcttatctgtaaaatgggaacagtattatcttgcttgcagttattgtaacttg

SEQ ID NO: 19071 - DNA, 295 bp, Homo sapiens
  ENST00000484922
attgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggagactaagtttgctggcccctggtataaagcattctccaaaaagaagaccttgaggctctctctaaagcttaaaaagactgaaagagaaccatcgtagtctacaagtgagaatgaataaaaaaatcacagaatatttaagccaac

SEQ ID NO: 19072 - DNA, 9556 bp, Homo sapiens
  ENST00000376020
ccggcggcgcctgagcccagccgaggatggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctctaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgtggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccaaattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggacttgtcaagctaccgagcaatttcttctcttgacctccttggagacttcaaacatgctttgaaaaaatcagaggaaacttcagtttatgaggaggggagctcccttgcctccatgccccacccactgcgcagccgtgccttctcagagagtcacatcagcttggcgccccaaagcacccgggcctgggggcagcataggagggagctctttagcaaaggtgatgagacccagtcggatcttctcggagccaggaagaaggcctttcctcctcctcgccctcctcctcccaactgggagaagtacaggctctttcgtgcagcccagcagcagaagcagcaacagcagcagcagaagcaacaggaggaggaggaggaggaggaagaagaagaagaagaggaagaggaagaggaggaggaggaggcagaggaggaggaagaggagctgccaccccagtatttcagttcagaaacctctggttcctgtgctctcaatcctgaggaggtcctagagcagccacaacccctcagctttggccacctggagggctcgagacagggttcacaaagtgtcccagcagagcaagaatcctttgcactccattccagtgatttcttgcctccaataaggggtcacttgggatctcaacctgagcaggctcagcccccttgctactatggcattggtgggctttggaggacatcgggacaggaagccactgaatccgccaaacaagagtttcagcacttttcgcctccttcaggggccccaggaatccctacctcttactcagcttattacaatatttctgtggccaaggcagagctgctgaacaaactgaaagaccaacctgagatggcagagattggcctaggagaggaggaagttgaccatgaactggctcaaaaaaagatacagcttatcgaaagcatcagcagaaaactttctgtcttgcgggaggcccagcgagggctgctagaggacatcaatgccaattctgcccttggggaggaggtggaggccaacttaaaagccgtctgcaaatccaatgaatttgaaaagtaccacttgtttgttggggacctggacaaagtggtcaacctgttgctgtcactctctggacgactggcccgggtggagaatgctctgaacagcatcgattcagaggccaaccaggagaagttggtactgatagagaagaagcagcagctgacggggcagttggcagatgccaaggagctgaaggagcacgtggaccgccgggagaagttggtgtttggcatggtctcccgctacctgcctcaggaccagctccaagattaccagcactttgtcaagatgaaatctgctctcatcattgaacagcgagagctggaggagaagatcaagctcggggaagagcaactcaaatgtctcagggagagtctactcctggggcccagcaatttctaattctaccagcactctgccacagcatccctgcccagccatgtgggaagtgctttcaatcttctttgttagcagtttctcagcaagtagatagcaattagcagtttgttccagccctctaccctggatgtctctcactaccccttccctagcagtggtcctaaccagctaggagaccctggggaagccacaagcttctacccaagggagctgcagcaaggtgtgatcttagaaccacactctccttcccacagttgccaagggcaagtacttgctgcacagagaaccaaggaagtgccttcattctgctttgtactaggacaccaaagacatcaagtactcatcacccacccatatcatcaacagcctctaaaggctcagagggaatctgccttgcagctctactctgccccagggcttgtggccagccatttctcacagagagctggctgccttgagggcattcacctggcaccagtttcagggcctcacccaagctttgcaggggaaagcacagagggaggaattacactgaaaaaaatgcaagcaaaggttgagtacccccaggtgccccttaggaaggaaccaggtttaaataggctctacccttacctttcccagcagcaagttcaggggaagaggcctactcttagccctggctagtgtgaccctcttcctgtcctaagactttggtcctaccacctcttgtttcatctttcctttacattgctgggggttaccgcaggtgcctaccccagggcttcaccatatgggccattaatagctctactaaaactgacttctagatgtaggtttcattattgggggagggggttcttattgttatattttaaatggccttttgattttatttatttttatgttttgattatttttttcttttttaactaataaggcgagaagagggaagttggagagggaaaagttagcccagaaggaaagcattttctgcagatcagcctgaatccaccgtggctaggtaagcaagtgccaaggcgttgaattgttcccaccatagctaccgatgtctaggaaggagttttccccttgaactcagagcctccctactgtggcctggccttgtgcttcccttaaagtctaagtgacttgagtttagcattccccagcagggtttaagtttttcttactgatttctttttgaaaccaaagaaatctcctgaaatggagaaaggttcagtcatttctctaccatctccaagctatgggatcagtagaggtgagctcagaaggaactcctctaaccattgctttctcagcctgtggcctggctcaagggaaccaaaactcaaggtagctgggagctccagccagagccagctccccagagcaattgaagacccagccaggatcttaggcatacaaacaactaaaactgctgctgttgccaaggccctgacaccagtagctagtttctatgctggaaaagcagccctcaggtggacgatggcaagaagggggttatggccaaatgctgccctgttatccagcttagctccctgttcctcactaactggggccaatccttggtatcacacaacccagccaaggcctggcatctcttctagttactgctgagttcctcagggtccttgaaggtcaactgtagcagcagggatgtctcattcaaccaaagaatttgccaaggaacttttgctgctgttacaaatacttgtcactagcttccatttcctcttcattgtatttgaaaacaatgggagaatcttggccagcagggtgtcctggggtagggggtggggtaagcctttctgtggagctctgggtttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgtgggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaagacagttatcagtcttaacttctgctgtctcccgtcaaatacttatacaggcccccatgggtaataggcaagcatgatggctgatagagaagtcagtgcatgagttactatcacatgtccccccaacccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttgggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgttgttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatccattgtggtagagtagaaagagtccagctttggcattagaatgaactgtgttcaaatcctggttctgccacttattcaatgaacctgggctactagctcaacttctgaggtcattttcttatctgtaaaatgggaacagtattatcttgcttgcagttattgtaacttgaaaataataaataaaagccactaacaatccaagaagttattaggcagaatcccaggcccaccccaaacccagtgatagcagtctgaattttaactagatttccaggagattcatgaacatattacagcatgggaagtactgacttgttgaaaacatattcagtacatggtaaccattattatagtcctgatctactcaattcattttttccttatcccaggcatattcttgctcttctcgtgttgctcacaactacctgcctggatgaatttaggaaagttgcaggatacaaggttaaaacacaagatcaaatgaacaatccgaaaatgttattaagaaaacagttccggccgggcatggtggctcacgcctgaaatcccagcactttgggaggccgaggcaggtggatcacgaggtcaggagatcaagaccatcctggctaacacggtgaaaccctatctctactaaaaatacaaaaaattagccaggtgtggtggcacgcaccagtagtcccagctactcgggaggctgaggcaggagaattgcttgaacctggaaggcagagattgcagtgagctgagaccacaccactgcactccatcctgggcaacagagtgagactttgtctcaaaaagaaagaaagaaagaaagaaagaaagaaagaaagaaaagaaagaaagaaagaaagaaagaaaacagttccatttacaatagcatc

SEQ ID NO: 19073 - DNA, 6730 bp, Homo sapiens
  ENST00000615301
aggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccctatcccacagtcattttaatttggtatgtgactgtttctttcatttctttcacagataatattatatatacagttatataaatatatttcatattaaatgttatataacacaagagagagaaagtataagtagaaagagtgcctagcaccctaagaaatttaaattaaaatgctaattatccattggtgagtgcagtctcgaggataggtgagtaaactgctctgtgttgaagtcacactgctgacctggttattgtaataaatcacctctttggttaatttaatttagttattttgttattcattgtacatttttgctctggttttagtaatttaattataatttatatcactgttccagggcatagtctcatgatgtgtgtgtgtgtgtgtgtgtgtgtgtgtgtatttttcaaagggtatgtgaacacccagtcatgtttgttctgcctttcaaatgaattttccttccagtttctcctacccgttgcttgttgctaagcatcaggagaggcagtagcagccacaaactgtgacacagttcttccaacttagagtgataccaaccaagtctcctgcatgctctgagagagtctgcgcctgagccagtttcaaatcatagctttgagaataaagagttggctctgttatgaggaaattaaggtcccttgttagtactctttaaaaggagaggtcctcagtgtgcttaataaaaattatagaatttgtcagaagtctaaacttagccaactcccctacaggtcagtacatagcaatttatataatttttaggagaagcaaatggtaaccattttaacgagaccctaaatcatataaagtggttggatattattatatctatatgtttgtgtctgaatatatttatttctgctactcctctgctataatcccaacactggcttacaaaagagcaattcaggcaatggatatgtcacatcattttttttttttttttttatcacttgcggattgctttttaaatgctgtggtatgaataactgggcatttaataaccttgagaatattaattcatttactgatgtgcttattcatttatactcattcttactccaaaaaggatctaagaagactcgcaaagataaaaataatacaagaaaaactaaaatttaaaaaggagagggaattaggaaaaaaggaatcaagggtaggaaagtgagatgaaattggctcttacaaaaaatggtgatgctctcacacttctacgtgaggttggttacaaaaatgtgtcagtgcttttcagcacagacatgtagaataaacacagaagatggacatctgttcccagcacagagagcttctagggtcattaggtttttgttctcagagatattctgattggtaaaggatggggtgtttgactgagtgtggagttggcaacaaaaatattggcctcttttactggagcgtgtccctgaaaaatggacaggagagctaatagacaaacaaaatccacatggaagtgtggtggctgcaaaacgaagttcacagaatttcaggcaaaaacatcatatatgtaatttaccaaacagtggaattagaagaataaaaaccacaagagttggtgaagttgaagaggaaactccatgtggagacacggcgccgtacttcagacctcccggtctactaatactgatggtgtggctggaacctggggtgtgtacagccctatccagaggatgctcctgtttcggctgattcctctacaccttgtgtggggaaggtgggcaccagcggctccctagccgcagcagcctcaagtgcctccgcagccttttcagcttcctcattaaagtaaaaaaaagtgtgttcttctttgaaacctatttaaagtaacaataaagtttactgtctaa

SEQ ID NO: 19074 - DNA, 3647 bp, Homo sapiens
  ENST00000497044
aacacacaatacctagaatttggagaatgctgcaagacagctttgagggcagctaccacttcttttttgcctgtgaaaattggagggaaagaactttgaattggaagaaagaagaacaccaaaagagaaagagagtgaaaggaattccatcctagtgggaatgatttaatgtgttgtattctttagggataagagtgtagaaatccagaaagcacagttctggccagacttacataggtggagcagtagaattgtcgactactattaaaaatgaattgatggtcctttcattgtatgccaaggattcttaaacagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccatt

SEQ ID NO: 19075 - DNA, 2190 bp, Homo sapiens
  ENST00000392901
gcgtgctaggaggcgaggcgaggggcatgcgtgctaggaggcgaggcgaggggcatgcgtgctaggaggcgaggcgaggggcatgcgtgctaggaggcgaggcgaggggcatgcgtgctaggaggcgaggcgagggccaggtgctagggctagaaaggaggcagggctggcgctctagggactcctggagctctcctcctgtgagcctggacccggcacctcacgcagcccatctcccacagcttccgtcgacggaggccggggcctcaccaggaaagtggtttgccctccaatcagtggtctgccttcattttccagattgatgaagtctgcctcagagaaggggcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcaataatctgaatcagaaaatactgcaactccttcctccttttgtctgccttttgttctccaaaagtaagtggaaattacatttccaagaaaggaaatgaaataattgcaggcccaaggtctgcaaaatatgtgttgaattgacagtgaaaaggatccatgtgttgacagacacagttgttagatgccataaaggcagatgtgaagctcaatttatttctcatcttgcttg

SEQ ID NO: 19076 - DNA, 358 bp, Homo sapiens
  ENST00000490615
ccaaagaattgaagtattcttaatcatgggacgatgcgtgggctcctggaatagctgactaatctttgaatgctgagattttttttccccctcattcctagtttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaa

SEQ ID NO: 19077 - DNA, 5308 bp, Homo sapiens
  ENST00000260777
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccc

SEQ ID NO: 19078 - DNA, 2400 bp, Homo sapiens
  ENST00000392903
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcaataatctgaatcagaaaatactgcaactccttcctccttttgtctgccttttgttctccaaaagtaagtggaaattacatttccaagaaaggaaatgaaataattgcaggcccaaggtctgcaaaatatgtgttgaattgacagtgaaaaggatccatgtgttgacagacacagttgttagatgccataaaggcagatgtgaagctcaatttatttctcatcttgcttg

SEQ ID NO: 19079 - DNA, 5361 bp, Homo sapiens
  ENST00000355371
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccc

SEQ ID NO: 19080 - DNA, 2517 bp, Homo sapiens
  ENST00000312960
ccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatg

SEQ ID NO: 19081 - DNA, 427 bp, Homo sapiens
  ENST00000482706
acttcggcgacgcttccccgagagtagcccccctcctcaacccagaaaagacaaccccgcggggctgcagcgagccagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagaca

SEQ ID NO: 19082 - DNA, 452 bp, Homo sapiens
  ENST00000472885
gagctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcggtgccaggccgggcacctggtgtgtaaccaatgccgccagaagttgagctgctgcccgacgtgcaggggcgccctgacgcccagcatcaggaacctggctatggagaaggtggcct

SEQ ID NO: 19083 - DNA, 7057 bp, Homo sapiens
  ENST00000400405
aagccgggctggagcggagtgtctcagaggctgcgctccttccagggcccaaggactcacagcttcctccgctgccttcccggaccaacaaccccccaaaagttgtgatgcttttctttacccagtgctttggggctgtattagatctcattcatctccggtttcagcactacaaggctaaacgggttttctccgctgccgggcaacttgtctgtgtcgtcaaccccacacacaacctaaagtatgtgtccagtcggcgcgccgtcactcagagcgctccagagcaaggcagcttccaccctcaccatctctcccaccaccactgccaccaccgccaccaccaccacctccgccaccacgcccacccccaccaccttcaccaccaggaggcggggctgcacgccaacccggtgacgccctgcctgtgcatgtgtcccttgttctcctgccagtgggaaggccgcctggaggtggtggtgccccacctgcggcagatccatagggttgacatcctccagggagccgagatcgtcttcctggccacggacatgcacctccccgcgccggctgattggatcatcatgcactcctgccttggccaccactttctgttggtgctgaggaaacaggagaggcatgaagggcacccccagttctttgccaccatgatgctgattgggacccccacccaggccgactgcttcacctatcgcctggagctcaacagaaaccatcggcgcctcaagtgggaggccacgccccggtctgttcttgagtgcgtggactcggtgattacggacggggactgcctcgtcctcaacacctcgctggcacagctcttctctgacaacggcagccttgccattgggattgccatcaccgcgacagaggtcctcccctcagaagctgaaatgtgaggccaggagccacggatgctccccacacagcctccctaggaaacgcctgggacctcccaataccaggactccagactcctttttattcttctcctttcttttttttttttttaatttttaattattattatttttttgtctcaggtactttgtgagatttagtttttgtctgccatgggcattatattatgtaaacatcctgtaatttaagatcttggtgtgatgtttgtcctgccttgttggtgttgttttatagaatgtttgtaagatttattcagaatagttttttcctgtcacctccaagtcctttctccgctagttttgaaaggatcaaaacaccatcaagcagactgttggggttgaaaggaggcttcgtgtgagaatcatttcttgtttctcttttcagtctatttcagagcaagctaaatctgaacgtgtgcagtcggcaggttggggaaggggcccagctcagagatggatcacatttcagaccatccagacatgactctgacagcttcccaggaacctcaaggtcaaagctgagctagccgggcatgaggagatcgtgtctccaccgcagggctggggactgggctagaggtgtcattgtgtgctgagtgctcaggttgatgctggggctcaggagagtagtcagaggcccaccttcctgtgacgggctcttgtcaccttgttcccaggctgtgccgtcttctcctgctctggaatcaaagtcctcagatttttgatgctttcttaaaaacccctttgccttctgttgagcaagtagtagaaaagaataggcaagatggggggtggggatgaaaagcaacaggaaaaagagaacataaaattaatctcccatctctgagagggcactccctcctcagagagttttattatcaagttataaaatccatcagttcctccctagggtgcagttctttcatatcatgcaaaaagcagaaccaggactcatcatcaaatgcaaagaactcagagggtggcacccaggatctctgacctggcgggctggtcatcacttacaaacctgggaggctctcttccctttcctcactttctaaaatgctcctaccgtcccattcagcacgcagacgtgaccacggctcaagtatgtattcagcacctgttgcagtatgaatgacacagtgacggaaatccatatttcctctgcgcaggctgctttctcttatttggttgtcagaacaattcatcaacatcttcttgtagaagtctctcgtgtatttgaagaaagtcagcatgtttagtcaactttgtcttttctgttctaagttggacacctataagccttcccagtaggacctcttctagctcctttttatcgcatttgtcccccccctctggctgctctccagacactgcagaagtcaggcaccccatccccagcacattcccatgacagccaaatgggcctttggccaaccagacattactctccgtgccctgttcctgcacctcaccccctcggcttggtcctggcaggcatccaagtgactacttagtctcaggcaggttgccctggctggccatctgcaattttttctccaccaaaaataactgatcctgaaacacaacacccttcccccaacaactgggttaattctccagccacttttggtgccaacttacacccccacgcaccagaagggaggtgccagtcgatacaagatttaataacagaggctgctctggtcacacagtaatcgctgggcccctggggctgagactgcattccgtcagagccctgagaggggcaaaaaacattgccacagatggaggcacatgtcagatgctgcagtcgcaaaaaaggattggggcctgcgcattctttgagctctcagatgccctgccagggcaccagccaccctcctccaatcacacagatgcccaagaacacctgaggctggtccgtctgtgcgtggaaagactggctgtcttcctcctcactgcatccccaatccccttcccagaacctaagacccccttggctgtaagtcttatgcctttagaagccacaggtcctctcctggtttttgagactcaaccactttgaaagcatttgtgtagcatcacaggtgctccagatcaacaaacaaaaacctcactaagaatataactaacattcacagggccttagggctcctgcagacatcacctttgccttctggttgtgccaagttacctgagccacactgggaatgacttcaggttattttcactgcacacaagactgtattatgaataagtgatcccagatgggagcttatatttttgttcctagaaagctttaggacaaagcatgggaaatgtattattatcttccatctatggtgctccccaaaaggcctctccatatccatatgtgaagaactggagaagaaggagcaaactaacaaccaagaattgggaataggaaatggtaccagcagtttgtatttgagcttcacagttcctgaagggctctttgatttgagtctcaggttaatcctcattagtatcctcaatatactaacagaatagaggttctaagacatgaagtgatcttttcaaggtcacacatcaggtggttagaccacaaccaaaacccagatcaactgactgcaaacttggtgttcttgaagtaagactgatccgaaatattcagcagtcttgccagcttaccagtggactgaggacctgagaatcaactgagtctttgtcctgggatagttgagggagcagggagagaaagactggagtagatttgcttttagaagcatctctgctttaagaactaggccagggatggtggctcacgtccataatcccaggactttgggaggccaaggaaggaggattgcttgagctcaggagtttgagaccagcctgggcaatatagcgagacttcatttctacaaaaaaaaaaatcagctgggcatggtgacacaagcctatagtcttaactactcggaggccaagacagggggatggcttgagcccaggaggttgaggtcacagtgagctgtgattgcaccacttgtaactccagcctgggcaacagagtgagaccctatctctttagaaaaaaaaaaaaagcactagtccacctggaagcagggggcccaggaagtgggtgggctgcagatggaggcttcagtgcgccaggccctttctgaatccctttgcccacacccaggtttctcaccttagagtcccaggagtccctgcacagaacgctgggatctggttgcctcattcacaccaaggtgcaagagttaatgactcactctctaaggagtaattgccttttaaaagaaggcctagagagacagcgcacttaacagtgaaaaatgagttaccagtatctgaacttcaggcatctgccagaggtttttttcaggaggtgtggagagaggagcattcctccccttgaggctgagcctacatacatggttgacgccgaaatggaggtcaggccacacgaagattgtctttaacaattggtatctgcatgaatctgtacctggtaaaccccatcactagctgtggctactctggacattttaggaatagatcagcatagtaaccataatagtactcatggctaccacttattgaggcttttctatatgatccagtaggctgcgtactttgaatatagtagatcatgtaatccccataacaaccttagcaagcaggtgctctttattgtattcatgttacgggtgggaaacgtaagctaagagaatttagccaacttgcttaagatcacccagctagcaaatggcagagctgggcctgggaccgggtacgtatggcttctgaccaacagcaaccatgtcatttctatgaacatatggacccaaggctcagaaggaccgagtcataaagtgtgaatggcatagaggccttttagtgctttcatactcaatatggccttttagctcccctttttctccctcttttttcaacccaagacctagtggagtactagagctgcttgtattctggttgttaatctttcaggaattttgcaagctgattgttaattaagtacagtcagtattaaaaatgatatacatttacaattaaataaattatatttaaagcaaaggtcaaaagtacttaaaactcatcacttcctaattatttcactactctttttattctctatgctcctggggttatttacatctatcacatctgtatgatgaacatactatataataatgtgctgcaccgcatcttccagctccacatttagtgacgtcatggtgattgcttgaaattagccatggtggaagtattcataccatggaaattagcaaatgctactagacagggatttttctccctagaaagccagttgttaagcacttaacagtataatcatccctcagtatccttgggggattggttccaggaatctcgtggacactaaaatctgaagatgctcaagtcccttatataaaacggcatagtatttgtatataacctacgcaatcctcccatatactttaaataatctctagagtacttataatacctaatacaatgtaaatgctatgtcaatagtttttatactgcattatttcttattgttgtattatttcttttttttttcctgaatattcttgattcacagttggtggaatccacaggtgtggaacatgtggatacagagggttgacttaataccactgcctagacattgctgatgagcacagcagggtgggagaggggactttggaaggagaagcaaggccctggaaggccgtactgacaagggcataaatgacagccaagccagcggaacagcaaattgttggggaaacacgaactcttctggagaagagactctgaggcttaagcagcttcaagagcattttctgccacagagcaccctctgctttctccccggacacttccctattgctgttagtgtggaaagttctatttggtggctttcatggaaaaattgggctccgcaaactcagcctattggctatcccaatccaaaaagcaaaaccagctctataaagctcaaatttcctgttacttgttcttacaggtcaccctccctacctctttcttacatgctggccaaaacctaaagaaatgttttactttgaaattagaaattggaaatatctaccattcaagagacacagcaagcagtggtgtcaaacaccacataagatgcattatcacaaaagtgggacccccgtaaagcatgaagctgagggacagaaaacataatgagccaaggaatgtcacatgaagaacagggccccgggccttactttcctacttggctacctcacttttttgcaacccagtaaggaccctgttcacaatccatagcctacccagaccaatactctttctaaatctggggcacagtttccactaggacaagagtcactggaaacttccagctaagtccattgaagcaggcagaatcttcaaggtcaatagtgcatcagttactctgatcccagtggtttcagtggaagggatggaagaagtgagggttgctgaagtttctacttggatgcatttctaagggaaaggggaagggatcatgggtgggaccccaaagagttaggctttgattgaggttcagctgcaaatagcatcatgagtggcgtctcctagtcagattgttaaatttcagatttttttgttcataagattttcttcaggaattggtgagttccccattgtgttcacctggaaaatagccagctgaagaaaaacttcactgaaaagaaatctgagagatctagtgtagataaacattaatttccccccaaatcaggtcatcacatgaactacctgggttagaatttgtcttttccaatattttctgaaagtatttcaccttggctactatactataaatactcctcaacctttttcagtcttttttttagggtattgagataagaaagagaaaggaaattgagaagcattttacttgccctgaattaatgtatatataattttctatgctttcttataatgttaaagacaataacttggacaaactcaaactgctacttcatctctgccctctcatagaaaatgtcattaaattgcatttgatattgtttccttcg

SEQ ID NO: 19084 - DNA, 5080 bp, Homo sapiens
  ENST00000264852
acatatttacatacatacacatatggtgagggagagaacgtgatgacgtgagactctccatggagagtaggaggtaataaagaaataaaacaggtgtctgaggagaggttctattagagaggggagaatagagagtaattatcgttcagacaggcaagagttctctgcaggtagcagcctgggaaagcgaactcgcgcaccctcttgggggacgggctcttttgctttctatttcttctcctgcagccagggtgcacacgtatttgaaacagaccgaatttcctcctcgatgtggcgtcaggttgacttttcgagactagcgggtatttctttttaatgactccaatgcctttttattattgctgttattgaggttgagggagaagagatcggtctaaattctggctgggtaagtggggggattctcggcgatgagaaacgggggacttagaagccggaggaaaatcagcagccccacatctccacttctccagtccgccctactctccacccgtgacctccagtggagaccccaggcggcagcatcagtatttgatcggcccttcgtcagcacgctgccagccctggccggctgggttcgccaggcatcacccgctcggctctgaagcggacgcctggccctgcaccgggctttggaaggaccctctctgcgctcgccccctccccagggtggctccgctttcgagcccgggcgcggtgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaactatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccaattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagacttgccagcaatggcagaatgctgctgcacacttccctccagttgtcaccctgcccagaaaggccagcagcttggacttcctgcccagaaactgtgttggcccccttcacacctctgcaacacctgctgctccagcaagaggatgtgattctttagaatatggcggggaggtgaccccaggccctgccctactgggatagatgttttaatggcaccagctagtcacctcccagaagaaactctgtatatttcccccaggtttctgatgccatcagaagggctcaggagtggggtttgtcacacattcctcttaacaagtaactgtcactgggaccgagtcctgggtgcttacatattccttcgtgtcttcatctcactgacctgtgtggacctcatcactctgactctgccttcttggaaaggccctgtcactccacagatgtctggccagcttcaaggcagaaggaaaaacaggaaaagctcttttaacagcagcaggaacaagagaaatgactaaccatactaaaagactggtaacagcagcagcagccagacaggcctcaccttaaggacttgggctgccagagcaaattcagcagagcttatttggcctcccattcacacagctcagttctgtgcccacatcacctttggggaagaaatcagcattctaatcagggacactacttcaggagtcctccacagcgagtccgtcatctgtcactttatgtagatcagggttctagacttcttccctgaggttctcagaagcagctctcaggatgaacgtattgtcctcttcccctcttcttgcaaagtgcacagctaatctaatgttgtctctcggttgcacctgacattctctccccagtaaggtgttggcaagctcagcatctgggttccactctcacactgtctggcagctctgtgtctgagaagttctacattgaccaggcccccttgttgcctggagtatgacgtaatcagaaaatagacgtataaatgtgcacatgcgtatgtatttgcttgtgaaattaaagtcacctcttgcctctgctttcctgatcattcgttagagaaatggatcaggcatttttttaaattattattctttctctaaactatttgcattgtgttcaaaaacccattttagaagtttgaacagcaagcttttcctgattttaaaaacacaaagttgctttcaatgaaatattttgtgatttttttaaagtccccaaatgtgtacttagccttctgttattccttattctttaagcagtgttggcttccattgaccatatgaaggccaccaattaaatggttgtgttaatccaacatgtaaaaaactttttggcagggcacagtggctcacgcctgtaatcccaacactttgggaggctgaggcaggaggatcacttgagcccaggagattgacgccgcagtgaactatgattgtgcccctgcactccagcctggatgacagagtgagaccccatctcttaaaaaataaaaaaaaataaaaatttgaacctgtttcacta

SEQ ID NO: 19085 - DNA, 1645 bp, Homo sapiens
  ENST00000491730
gtatttgaaacagaccgaatttcctcctcgatgtggcgtcaggttgacttttcgagactagcgggtatttctttttaatgactccaatgcctttttattattgctgttattgaggttgagggagaagagatcggtctaaattctggctgggtaagtggggggattctcggcgatgagaaacgggggacttagaagccggaggaaaatcagcagccccacatctccacttctccagtccgccctactctccacccgtgacctccagtggagaccccaggcggcagcatcagtatttgatcggcccttcgtcagcacgctgccagccctggccggctgggttcgccaggcatcacccgctcggctctgaagcggacgcctggccctgcaccgggctttggaaggaccctctctgcgctcgccccctccccagggtggctccgctttcgagcccgggcgcggtgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaactatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacaggtgaggcattgcttctgtgggcattattgccaatggtaatgctcaatagatagtgtacttactgggccagcatccaaaagggatggccatccatgatgtgcctaggatctccttcctttctgattggtttaaaaactaatatgtctggccaggcgcagtggctcacacctgtaatcctagcactttgggaggccaaggcgagcggatcacctaaagtcaggagtttgagaccagcctggccaatatggcaaaaccctgtctccactaaaaatacaaaaattagctgggcttggtggtgcacacctgcaatcccagctactcaggaggctgaggcaggagagtctcttgaacccaagaggcagaggttgaagtgagccaagagcacagcactgcactccagcctgggcgacaacagcaaaactccattgaaa

SEQ ID NO: 19086 - DNA, 566 bp, Homo sapiens
  ENST00000483946
cagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaactatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggtaagcgggactttctctgtttacctgtctgtgtttcctgtgcttgtggatgctcaattcatcttccatccttacagactggtactctggaaggaaattatccacttagcatatgattttagcacttcctgaactctcctgcccataactgagcagcagggccttaatctatacaaaagagtgggagtgcagaaggtaagagtggt

SEQ ID NO: 19087 - DNA, 648 bp, Homo sapiens
  ENST00000488390
attttttttaaaccagaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaataggtatgtcctaccaggtctgttcatgaaagtgtttcctaattctgcagagaatatgatagaaaggcattccagccactaataactgggaatgtgggcaaagcagctatcctatgagattgtcttttatttgtaagatgagttgcttggagatttggaagcttcctcccagctctaactttctccagttctgttgttctgtttcttggatctgctagccccacttgggcagaattccttcaatgtttgccatctaatactaaggccccctagggactttttcatatccagcccgggtttagggcatgaaagatgtgtcccagggagcctgacatcaattgaccagttgtttc

SEQ ID NO: 19088 - DNA, 704 bp, Homo sapiens
  ENST00000480746
tcagcctcccaagtagctgggactacaggcacctgccatcacgcccagctaatttttgtatttttattagagacggggtttcaccatattggccaggctggtcttgaactcctgactttgtgatccgcctgccttggcctcccaaagtgctgggattacaggtgtgtgccaccgcacctggccccaaagacatgttttgaagagatcctagtagacaaatccgcaacaaaatctataaggaacaaatgtaaaatgctgaggttttcactgtcttaggagcatgtgtatgtgcttgtttgcaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagac

SEQ ID NO: 19089 - DNA, 361 bp, Homo sapiens
  ENST00000468728
ttttccccagtcatttaaaggtttgaaaactaatcttagttgaagagccatacagaaacaggtggcaggctagatttggcagatgggtcatagttttggtgactcctgtattagtgtaaaaagaaaatcaaacctaaaataatgtgccctgatgattcaagctacttagaatagtgttgttttgttttagcaactggacataaagtgtttgcctcttcactttttttaacaggctctggaaatatggtggcatctcatcccattgctgccagcacacccgaagggagcaattatgggacaatagatgagtcaagctccagtcctggaaggcagatgtcctcctccgatggtgggccaccgg

SEQ ID NO: 19090 - DNA, 1471 bp, Homo sapiens
  ENST00000463226
atctgaacagaagaaataaagcggaagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacatgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccaattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatgtgtctgacacagcagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacaca

SEQ ID NO: 19091 - DNA, 532 bp, Homo sapiens
  ENST00000465803
gttcatattttaacatatgaaacatgaaatagaagtataatattatttttgtatccaaatagttaacagagcagatgcccttagattctaatatgtgttcagtcctgaagatagccaagttaaatataaaaacaggagaagaggaaaaataaaagtccattgagaaggaatagagagaaagaacaggtcttgtgaatgagaagttcatttggatcaacacagcatttcctagaatgagtctgcactgtgctttttgcagagacgaatgggctccgtaggctctccacggcttttgatggcagatgagttgtctctgtttcagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaa

SEQ ID NO: 19092 - DNA, 733 bp, Homo sapiens
  ENST00000492863
gtgtgttaatgatctaataatatttagtcaattgcatacttattatgcagtgagaaaaaggacttcatgaggtttgagcaccactgtttataatctaaatcttctctgcatactttgggggactgtcagaagatacacctggactgtggtttgggaaagttcttgacagagatggtgataaatagggaaagctgaacacacatctcctcgtgtctacctgcctcatgtttaccatttctacccagaggatgggacagctctatatcccctctgcagtaacctagaaaataagacatagtgtgacagtcctgaaaggccccaatgttcgcattctttcgtagtccttttatcataacaaaggaaatgcaattggatgaattccaccttggggctgcataagagggtacacagaatattcccattcaaagcaagatggtaacttttttgtaaaaaaagtgcctgtgctgtgtaaggtggcagataatggcccatctgtgcagaggagcactggttacattgtaaactagtgacagtgcatctccgtgagccctgtctgctctttgtgttcctgctggggctcagaggacggaggaaaaccacatttcctcttctcactcttgattttacaggtggtaaatgtcactggcaaccaggacatctgttactacaacttcctctgtgctcaccccttgggcgtcctgagtgccttcaacaacattctcagcaatctggg

SEQ ID NO: 19093 - DNA, 386 bp, Homo sapiens
  ENST00000481891
accttgggccacttcagagtatttgtatttttgttgactaagccttctcaccatgcatttgtattatcagcagatttgggaattttccggcgggctgccatggtgttctacacagactgtatccagcagtgtagccgacctctatatatggatagaatggtgttgctggttgtggggaatctggttaactggtccttgtaagtagtcttatgaaaacatgtttttgcctttattaatgtcagtaacactgtggtttagctttccttgactgtcatttttacaaagaaatctgaaattaaggagaaggtaggactgcttgttctagagactcaaaaaaaggtagtaggacattctcgtgtagcaattgtagcctctcttaaaacact

SEQ ID NO: 19094 - DNA, 577 bp, Homo sapiens
  ENST00000498152
atttttgctttggttgcctgtgcttttgaggtctttgtgtacaggtttttgtgtggatggatgttttcttggaagctaacttttcgaaccagacatctagtagcgtttttgtggctttctggacgttcaactctttgaacagttgaactgtgggaatcttgcccatgtcctgcctcaccttcctccagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaa

SEQ ID NO: 19095 - DNA, 2572 bp, Homo sapiens
  ENST00000393830
agggtggctccgctttcgagcccgggcgcggtgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaactatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccaattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatgtgtctgacacagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatca

SEQ ID NO: 19096 - DNA, 4220 bp, Homo sapiens
  ENST00000488337
ggaggtggtagagtgcagcttcaacatttgtgtggtctctttgctcaagccagatggcatgttccaccccacatggaagtaacagaagactacccagaaaatgtcatttctctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaa

SEQ ID NO: 19097 - DNA, 6331 bp, Homo sapiens
  ENST00000445177
cggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaa

SEQ ID NO: 19098 - DNA, 6213 bp, Homo sapiens
  ENST00000375300
aacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatccatgttctccatcttttgtgaaagtatatttgagttggtggttttttgttttgtttgggggtttgtgttttgttttgtttttggtatgttttcttccagaggtgatatactttcttttttttcttcctttcttttttttctttcgttccttttttgaaacaggagagcaaagcagttagagttcagaggccagcggcctcagggccactccctccctagccttcatcagcagagcaccctccatccccctgcattgctcttctgtgaaagcaaatactaaaggatgccatcctctggaatcctaatggcaggcaaagggagagaggaagggtgacggcttctggcacttagaaaacaaaaagaacaaaaaaagagaaacccccaagcctggaacgcagagaggtctttactgctgggatccacggaaaacatgtctgtcctagccaagatcatatgaagagtttggcacggaggctgagaatgacctggcatagatggtttgccagttaggatgtctcaatttgagcctttgcttttggtggataactcagctcccctcttgtaacctggaaagttggttgcctttatcatcctgctggttttatccatggactgaacacccaacagcagtgcactatgctttctatggcatctttcattctcattttatattgtgctataaaaaggattgtttctccatatatatattatatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaa

SEQ ID NO: 19099 - DNA, 294 bp, Homo sapiens
  ENST00000454905
gaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggacattctgctcagctacaagcaccccgaagtctccttcagcatggagcaggcaggcgtgtaacaagaaacagagagagagcaaagcagttagagttcagaggccagcggcctcagggccactccctccctagccttcatcag

SEQ ID NO: 19100 - DNA, 3459 bp, Homo sapiens
  ENST00000465421
aattcatttgttttttgtgttgctgaaccaaatacatgttcgtgctcatttcattagctcactgctgggtcaagcctcaggtagagtctgaaacaaaagccatcattagcaaagacagggtaaaaggctttcacctgctgccagaactctctggatacctctgcacggtcattagattcctcctggtcccgcgctgtctgcattgtatttgaactcgcttgttaacctgcttcctgagctgtggttctgcttcagtcccaaatgaatcactggcaaggtagcacatcatttcatccaaagttcagtgtaatggcatctctgccctggacatgaaaccctgatcctttccatctgctactggaatgctgctgccttggcagtcttttatctgcttacctcagcccataaacatctctttctgatcatcaggtcacaagagtaggtgttagcttctaaccccgatgctgtcttaggcattccttatcaatagcttgttctttctttctgtaagattctggctgtgttccagttgagcagtggggtctttgaaggtaatccatatgattcctctttcattaggaggttgggtgagtgctgctgctctgagaagttgattttcacagtaggtgaccttatttgttgaccaggtacgtgcaggatctcaaggcccacattccttaagaatttgttgtctccatcccaggatcagaagtcttcattttcccccaccccaatcgccaccttctattttctgtcacagaacctatgagttctaggccagacctttgaccacaaaactgactgttgtttccctctggccatacggagatcattgctcagggaaaactttggctcaaatggtgaatttaaggtttctaaaggcactagatagacatatgattataaaagcaagagcttctgtacagtctggcctggaggatattgagaagcttttctctctggcctagtgtatttataagaactggatgtacttgatctcgggacctcaccaggcttggaaagtaagccaaccgaaggtaagtagaaatggaagatgtacacctggagccctctaaagggaagcaggctagggaaacgactgatgtctggaaatggcatgaaagtggcataatatgcagggctacctgggcagccagccgtctttatgttcatctggaacagcagtccctgtgtgatttggtcaaagcccctgagtcctagcctctaaccttctcttcccatatattcagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgtaaacccacagtatctagcagcgttgtgccaaattgcccttgtgtttctctccacccaaaatatcacagctgctttcctcacatttggttcatccgtgtgctgttcttttgggttctgagagggttttgccatgtttgcttgtatgaccaagtcaccaaggaaataaacaggaaggaaatcc

SEQ ID NO: 19101 - DNA, 3816 bp, Homo sapiens
  ENST00000415541
cgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttggaggatttggacatcagcaattctcattctgccccgagctgcctattgctgagtcctggagaagtgcagttaagagatgggggccccttcttctactcagcccccacttgtggaacttgatcagaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgt

SEQ ID NO: 19102 - DNA, 3858 bp, Homo sapiens
  ENST00000446921
ggaggtttcactgcacaacaagatggcggcggcggcggcgagcggagctggcggggctgccggggccgggactgggggagccgggcccgcgggccgcctgctgcctccgcccgcgccggggtccccagccgcccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcgctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggagtgtgagcagctgcagaagatgtacggggggcagattgatgaaagaaccctggagaagacccagcagcagcatatgttataccagcaggagcagcaccatcaaattctccagcaacaaattcaagactctatctgtcctcctcagccatctccacctcttcaggctgcatgtgaaaatcagccagccctccttacccatcagctccagaggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagagagcctgtcatagggaactgcatggatagaagttctccaggacaagcagtggagctgccggatcacaatgggctcgggtacccagcacgcccctccgtccatgagcaccacaggccccgggccctccagagacaccacacgatccagaacagcgacgatgcttatgtacagctggataacttgccaggaatgagtctcgtggctgggaaagcacttagctctgcccggatgtcggatgcagttctcagtcagtcttcgctcatgggcagccagcagtttcaggatggggaaaatgaggaatgtggggcaagcctgggaggtcatgagcacccagacctgagtgatggcagccagcatttaaactcctcttgctatccatctacgtgtattacagacattctgctcagctacaagcaccccgaagtctccttcagcatggagcaggcaggcgtgtaacaagaaacagagagttttgtgtacagcttgggaatgaaaaggttgattgt

SEQ ID NO: 19103 - DNA, 2237 bp, Homo sapiens
  ENST00000480468
ggttaaggattcagccttcaagcccaccccccaaccaccccaacaaccatctcttcaggcagcccagtaatagtcctccccccatgagcagtgccatgatccagcctcacggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacagcttgaacgtgaatcggttctcccctgctaactacgaccaggcgcatttacacccccatctgttttcggaccagtcccggggttcccccagcagctacagcccttcaacaggagtggggttctctccaacccaagccctgaaagtccctccacttgaccaattccccaccttccctcccagtgcacatcagcagccgccacactataccacgtcggcactacagcaggccctgctgtctcccacgccgccagactatacaagacaccagcaggtaccccacatccttcaaggactgctttctccccggcattcgctcaccggccactcggacatccggctgcccccaacagagtttgcacagctcattaaaaggcagcagcaacaacggcagcagcagcagcaacagcagcaacagcaagaataccaggaactgttcaggcacatgaaccaaggggatgcggggagtctggctcccagccttgggggacagagcatgacagagcgccaggctttatcttatcaaaatgctgactcttatcaccatcacaccagcccccagcatctgctacaaatcagggcacaagaatgtgtctcacaggcttcctcacccaccccgccccacgggtatgctcaccagccggcactgatgcattcagagagcatggaggaggactgctcgtgtgagggggccaaggatggcttccaagacagtaagagttcaagtacattgaccaaaggttgccatgacagccctctgctcttgagtaccggtggacctggggaccctgaatctttgctaggaactgtgagtcatgcccaagaattggggatacatccctatggtcatcagccaactgctgcattcagtaaaaataaggtgcccagcagaggtaagtgtctcctcacagtggaagtcctgggccagtctgccctaatcaactgactcagtaatgttatcttttttcagctagtattctgtgttcctaagaaaaaaagaatttctgagcttcacgaccttcttggggagaagcatgtaggaagtgggtattggtgggcaaggggtccattttcaaaatcaaaggaccatgatacaaaattaacacttagtcaataagatagatgatccatttcccttattcataccacagtttcttggaatccagaaattcctgactgccatccaaacagctaactttaaacttgtgcaatagaaaaaaagtcagcccaacataatttagtgtaaatagtgtgggaacaagagtcagagcaccttaattctgctcttgcagctatcataaatacgataactttgtcatttaatccctctgattctgattttcctcatctgtgaagaaggtgttggaggaacaatggagtatcttacggtgtatctgtggagatgaaaacatgtatatatgtgtttgtttctacataatgtttgcatgagagagagaggcacattcagatcatctgaaatgtttgagttcagtgcataaatgtgaggtattattactctggtcgttttattagtgagctaaatgcagaatattacagcatcataagggcccccattatcatttcattttgtaccactttataattaatgagtatattcattatcattctgaaggagatcaggattgcaattagtaagttatacttagaaaatatagttccattagcatcacggcattcatcctagacaaaatcaggaatcttgcaatttaccactcctcaccattgccatccaagggaataaaaagcaatttatctgtaaactgtacaa

SEQ ID NO: 19104 - DNA, 665 bp, Homo sapiens
  ENST00000480222
tctcatggtccgtcctccccactctgttcctggcaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtacttggcaaataggtccaaaagacatacactggccatgaccaaccctacagctgagatcccaccggacctacaacggcagctaggacagcagcctttccgttcccgggtctggcctcctcacctggtacctgatcagcatcggtgagtagccacatgagctgtgcgagctccttgaggctcatcggacaggcacccttctgattagtctcacagcgacggtgactagcatcgtggctttaaatagaagccagctgtcatcctgaactcacatcttctcagctccttgcagtaagcaatgcacagggcaaaggttttttactgcgccctggagcaatgcgagattcctctctcccattaccttgcagacctgtttattgtctgcatttgattcccatgatt

SEQ ID NO: 19105 - DNA, 3054 bp, Homo sapiens
  ENST00000413553
taagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagaatgtgagcatttgatccgccatatgttggtgttagatcccaataagcgcctctccatggagcagatctgcaagcacaagtggatgaagctaggggacgccgatcccaactttgacaggttaatagctgaatgccaacaactaaaggaagaaagacaggtggaccccctgaatgaggatgtcctcttggccatggaggacatgggactggacaaagaacagacactgcagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagcagtgccagcagttacccctgtggacgaggagagctcagacggggagccagaccaggaagctgtgcagaggtaatgtgacatctggcagtgcttgcagaagcccctgggcaggctcccctgcaaccagcgaaaggtcacctctgcccaaggaggtggtagagtgcagcttcaacatttgtgtggtctctttgctcaagccagatggcatgttccaccccacatggaagtaacagaagactacccagaaaatgtcatttctgtaagcaccattggaagtcccctaagtgacagcaataaccataagaactttttctttcctccctccttcttccttgtcccctgccttcatattgcaactctgatagtattcacaaggcacaaagcctgctcgtacctgccaagaactgtttactgaaaaggaattggagatgtgggatgacagtgatcctagctagtctggccatggacctctggcatggacttttcctttccaggagaatgaatacctcttgtactgtttgctgtgtgcttcttccacccccttgtaccaacaaagagatattgaaaaagagaatatgggattcgggccagggacagatgcaaatatccattgtttacagaaccttgttgagagatgcctaactcacagagaacggcagtgaccatcaggcatgctgtactgttcatttggcctcagttccgttagccctggtccttagctccatgcatgcccccttgtgggagttgattttcttattatccggggagggggtttcaccagaatccagcatgtattttcccagaaatacaggtgttcttcaagattatatgttttttcctttgagggaagttgaaataaaatggttttcatgggcttttggggaactttgggtgtctttatccaatggttattaaaacattaatggcttactctttggcaagttcacataacactgattactctacagtctgttaactgattttagctgaaaggggcaagatagttaagaatgaaatgagaccattttttaagaacctgccagttgctggctaggactctcatcctatccccagtagctctgtgtgagagctgctattcagaaagcagctggtcctatgtggaaagaaaaccatggcaaacaggggtgttggcaggtgggccagctccttctacagcttggccaatagaaggaaaattctggtaacttttttttttccttgatgctgttgtttctatagtttgctgataagagggtatataaggttacaaatgggccctactgggtcatgaagaaatgagaaatcaggaaatttactgcctttctaccttaaaagagacagcaatattttatcttctttgtcttagactttccttcctccaggtctaccttctttcttctttagaccaacatttcaagggtataatgcccatcagttttgatgtaataaaaaaggtgtagtgcctcttttattcatgcctccagaagagcagcagcggtggaggaagtcatccaccagacaaagagggacaatatcttattgatggtattaactaagtgctgggtctgaaagatcttccgaataaaagccatcagtttgggaactctt

SEQ ID NO: 19106 - DNA, 267 bp, Homo sapiens
  ENST00000472648
aagactcattatttctctctagtgttaaaggtatgcgtgtatatgtatgtactgctttccaggcggagcaggcaggtactgctatgaacatcagcgttccccaggtgcagctgatcaacccagagaaccaaattgtggagccggatgggacactgaatttggacagtgatgagggtgaagagccttcccctgaagcattggtgcgctatttgtcaatgaggaggcacacagtgggtgtggctgacccacgcacggaagttatggaag

SEQ ID NO: 19107 - DNA, 715 bp, Homo sapiens
  ENST00000497049
gttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcagattttggtttcagtaacctcttcactcctgggcagctgctgaagacctggtgtggcagccctccctatgctgcacctgaactctttgaaggaaaagaatatgatgggcccaaagtggacatctggagccttggagttgtcctctacgtgcttgtgtgcggtgccctgccatttgatggaagcacactgcagaatctgcgggcccgcgtgctgagtggaaagttccgcatcccattttttatgtccacagatcattaatgattctgaagtacacttttggcagaggaacaggagcaaaagcttaatcatgtggttgcaacaaaaaaggaatagaaggaaaatagacgacacgctctttccagtttactataaa

SEQ ID NO: 19108 - DNA, 764 bp, Homo sapiens
  ENST00000485363
ccccgctgccgtgtcccctgcggccggccagccgcgtcccccagccccggcctcccgcggacccatgcccgcccgtatcggctactacgagatcgaccgcaccatcggcaagggcaacttcgcggtggtcaagcgggccacgcacctcgtcaccaaggccaaggttgctatcaagatcatagataagacccagctggatgaagaaaacttgaagaagattttccgggaagttcaaattatgaagatgctttgccacccccatatcatcaggctctaccaggttatggagacagaacggatgatttatctggtgacagaatatgctagtggaggggaaatatttgaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcaggtgaaaaatgttctaaaactgattgtggtcatcgtcgcacaactctgtgaatgcgctaaaagccgctgggcattacactttcaatgcgtgaattgtatgggatatggaatacaagaaatatgttatggccaggtgcagcggctcatgcctgtaatcccagcgcttcggaaggccgaggtgggaggatcatgtgagctcaggagttcgagaccagcctgggcaacacagcaagaccctgtctctattttattctatgtt

SEQ ID NO: 19109 - DNA, 521 bp, Homo sapiens
  ENST00000553453
actgccggcaactttgtgagcgagttcagtgcgtgcgtgagcgagtgagcgaaaaggagagcgcgcggcggacgcgcccgggacgcgcggcggcaccgggaggccgggccgagcggtcttaaaacattttggaaaaagttgaagctctccttttctaccctcctgattctgtgcttctgttggagtgcatatcacttgatggcttctaagacaaatgctaaattcttgtcagattacgcaagtctcggtcttgtcacccagactagagtacagtggtacaatattggctcactgcaacctctgcctcctgggttcaagcgattcttgtgcctcagcctcccaagtagctgggattacaggccctccctatcctgaagacattagctgagagtctggcaccttttaaaggtctgatcatcaattgtctctctgggcggccacctatgagacttcatctgtgtggttataccttattggtgtggacgttgtctaaatttcggtagccatggcacaagaatata

SEQ ID NO: 19110 - DNA, 569 bp, Homo sapiens
  ENST00000555989
actgccggcaactttgtgagcgagttcagtgcgtgcgtgagcgagtgagcgaaaaggagagcgcgcggcggacgcgcccgggacgcgcggcggcaccgggaggccgggccgagcggttttgagagattacctgaagttgcactcaaaagcaagatatactactaactttgaaatggaataaggatagatgcccaggtgcatgatttctgagtcatagggccctccctatcctgaagacattagctgagagtctggcaccttttaaaggtctgatcatcaattgtctctctgggcggccacctatgagacttcatctgtgtggtggacttacagtttctggctactactggtggaaaatgatgggctcagacaagagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatg

SEQ ID NO: 19111 - DNA, 903 bp, Homo sapiens
  ENST00000556408
ttcagtgcgtgcgtgagcgagtgagcgaaaaggagagcgcgcggcggacgcgcccgggacgcgcggcggcaccgggaggccgggccgagcgaaatgtggtctcgctgtgttgcccagtactggcctcaagcgagcctcctacctcagccttccaaagtgttgggattataggcgtgagccactgcacctggcacagtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatatagatgtggagaaagtttgggacctcaagagaaagagtggatgtctacagctgcacaaggaagggcaaaccagcagagctcctgggacctgctgaaggaggaaagatgcccgagagctgggcagaggaaaatccctcctgctttcaacaactatgcatttccaaatgtcgaaagagagattgcagagctcaacaacatgaatattttctggcttacctgccaatggtttttttctccccctaaaatgaaacaatatccattatctctagcgacatgtctattttaactttgtcactgttaacagtggttactgg

SEQ ID NO: 19112 - DNA, 576 bp, Homo sapiens
  ENST00000554126
agtgcgtgcgtgagcgagtgagcgaaaaggagagcgcgcggcggacgcgcccgggacgcgcggcggcaccgggaggccgggccgagcggtcttaaaacattttggaaaaagttgaagctctccttttctaccctcctgattctgtgcttctgttggagtgcatatcacttgatggcttctaagacaaatgctaaattcttgtcagattacgcagttttgagagattacctgaagttgcactcaaaagcaagatatactactaactttgaaatggaataagaacataagagagcagctgcccatgccaaatagttacctcttttaaactcattctactggagcaaatggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatatagatgtggagaaagtttgggacctca

SEQ ID NO: 19113 - DNA, 591 bp, Homo sapiens
  ENST00000556780
agtgcgtgcgtgagcgagtgagcgaaaaggagagcgcgcggcggacgcgcccgggacgcgcggcggcaccgggaggccgggccgagcggttttgagagattacctgaagttgcactcaaaagcaagatatactactaactttgaaatggaataagaacataagagagcagctgcccatgccaaatagttacctcttttaaactcattctactggagcaaatggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatatagatgtggagaaagtttgggacctcaagagaaagagtggatgtctacagctgcacaaggaagggcaaaccagcagagctcctgggacctgctgaaggaggaaagatgcccgagagctgggcagaggaaaatccctcctgctttcaacaactatgcatttccaaatg

SEQ ID NO: 19114 - DNA, 552 bp, Homo sapiens
  ENST00000554362
agtgcgtgcgtgagcgagtgagcgaaaaggagagcgcgcggcggacgcgcccgggacgcgcggcggcaccgggaggccgggccgagcggtcttaaaacattttggaaaaagttgaagctctccttttctaccctcctgattctgtgcttctgttggagtgcatatcacttgatggcttctaagacaaatgctaaattcttgtcagattacgcagccctccctatcctgaagacattagctgagagtctggcaccttttaaaggtctgatcatcaattgtctctctgggcggccacctatgagacttcatctgtgtggttataccttattggtgtggacgttgtctaaatttcggtagccatggcacaagaatatagtggacttacagtttctggctactactggtggaaaatgatgggctcagacaagagaaagcatgggattatggcaaccacagaatctcagtagtacaagttccattcagttttttctgaaagaaagccctctgttaaagtgaagcaaagaaactgttgtggattataacgtttagaag

SEQ ID NO: 19115 - DNA, 379 bp, Homo sapiens
  ENST00000555652
gccgagtccccggctggagggtccccggggagggccagggagagcgcgcggcggacgcgcccgggacgcgcggcggcaccgggaggccgggccgagcggttttgagagattacctgaagttgcactcaaaagcaagatatactactaactttgaaatggaataaggccctccctatcctgaagacattagctgagagtctggcaccttttaaaggtctgatcatcaattgtctctctgggcggccacctatgagacttcatctgtgtggttataccttattggtgtggacgttgtctaaatttcggtagccatggcacaagaatataagaaagcatgggattatggcaaccacagaatctcagtagtacaagttccatt

SEQ ID NO: 19116 - DNA, 744 bp, Homo sapiens
  ENST00000557151
gcaccccagaacccgaatctgcacaactactgggcaggcgtctctgcgggaggccaggagacccgcgtcccggtccgggcggttgcgtccaccccgctgagctggtcgccacctggcgacccttcccctccagtcacctgggccctccctatcctgaagacattagctgagagtctggcaccttttaaaggtctgatcatcaattgtctctctgggcggccacctatgagacttcatctgtgtgctttataaatagcagtccagggcaacagtacttgataaaaaggttataccttattggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatg

SEQ ID NO: 19117 - DNA, 457 bp, Homo sapiens
  ENST00000557469
agagattacctgaagttgcactcaaaagcaagatatactactaactttgaaatggaataaggtgagttggtggattagttccaaagtcacattgcagggaggaaatgtcactcaaactgtcattcttagaagacctgctatttggccaggcgtgagccaccatgcccggatgtattaatggtattttaataataactcttggttgataaacttaaacatgacagttttgagcaggcaccttaagttctgtatactaccgtgaggccaggcacttgtttagcttctgtgtcatacagctaccccttgtattttgttctttttttttttagtataataaatctatagttttattaacacagaaactgatagtgtggtatgaggtttacgtttaaacaaagttttcacagaaatctaacacatgcctaaaaagattttacaatctagctctagatgcaag

SEQ ID NO: 19118 - DNA, 1823 bp, Homo sapiens
  ENST00000557712
gtggatatttacaaatgcaccgttggattctttgtcgttcaagtgaatgttgactatttacaggccctccctatcctgaagacattagctgagagtctggcaccttttaaaggtctgatcatcaattgtctctctgggcggccacctatgagacttcatctgtgtggttataccttattggtgtggacgttgtctaaatttcggtagccatggcacaagaatatagatgtggagaaagtttgggacctcaagagaaagagtggatgtctacagctgcacaaggaagggcaaaccagcagagctcctgggacctgctgaaggaggaaagatgcccgagagctgggcagaggaaaatccctcctgctttcaacaactatgcatttccaaatgtcgaaagagagattgcagagctcaacaacatgaatattttctggcttacctgccaatggtttttttctccccctaaaatgaaacaatatccattatctctagcgacatgtctattttaactttgtcactgttaacagtggttactggtattccagtactttttcctaatgtgtatagtgttgttttgatttgtatgcctttgatgcttattatactcagaacagtagatgggccttttcttgtgcttgtgttctgtcaaagaatttttcttagttcaacatattctttctttaaaacttgttttaactgcagtgatgccagaaagtttcaaaaagacagttcctcactttttcttggcagcagttctggtgttagaaggtaataacacatagtgaaatcatgatttatttaaagtagaaattttgatttctacaacaaaaatcttgatttttaaccaccataaatttcctgtagtaatcccaagggatgctgtaaaaagaataaggtggggtaggggtgggagtggaaggggtggacaacttcctgaaagagaacataccccagtgcaatcttgaaggaggagtaagagttagaggagtaaagggtggataagaataaaacaggaggaggaaggaagagaattgaatggagttgtgttccagcaaaagttaccacttggcttcacctgaagtctcacgagaacccggtgcattcaagaaattttaactggtttcctttccctttgactggagctcagggttcagggagcatggtgggaagagtgtggagagattgggctgttaattagggagatttatcttgcacttaggaaattctgacattgcaaaaacagagaggctatctccttgaggatttaagcgaaggaggctaagactcgtgctaatatgcaccttataaacagtcttgaataggcaaagtgatcagtttttaaaataagcattattgcagacacacaagactatgttttaagatcaaacttacattctagttagaggatttattttactttgtcacaaaaatgaaaaggttggcaaaaaaaaaaaaagacttcctgccacaaggttttatctttgaacactttattggtttgcgttttgattaattttttttctagttaataagagtttaaatgatcaagttaatacatttgtgaggaaaatctcacttagaaatcagagatttttaagtttaggggattagattaaaaataattttatttgaaagttaggcataaaatgtatgtatatttgcatatgtgcatagtttttaaaaaaaactggaaggatgtggtatgcattaaagaaagatactttgtttgctcctgctttcatttctgttgacaagttgccagaattatttgtatagggcctctattttcggaaccatgatataaataaaggattcaaaatgtt

SEQ ID NO: 19119 - DNA, 5944 bp, Homo sapiens
  ENST00000381232
ggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaa

SEQ ID NO: 19120 - DNA, 7831 bp, Homo sapiens
  ENST00000555818
ggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggcttacagttatagaggacctcaggatttcaattcttttgtcctcgagcagcatgaatatacagagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctttatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatggccatccaaaggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtccacatgtcgatagagaattact

SEQ ID NO: 19121 - DNA, 6539 bp, Homo sapiens
  ENST00000358550
gagtcttctaaagtgatgctgtgtgctgcaagagaaatgaaagcgcctgccttggaggcaggaagccgactagggagatgcttaattatcgtggaagtaggtgcttgttaccattgagtggagagtgcagcaagtgcaggtcgtcctccggtgtcagagccgtgatttgtagacaatgccgccctgtcagctcagtgctggttcagcagcatctttccaaacatgtatttggcaagaatttaaaggccacctcttgtgtaatttgtggagtcttggaaaaggagcctctgcctttcttttcagaatgtacgcaaccatgcagaattttgtactcagaatctgtgtctcctgccttctgcctgacgtgctcatgaggaagtttgtttccatgcccgtcacctggaaggatgctaacagttctctgtaatctgttggggatatggagagggccacccagagctgtgttttgtttctgccgtcttcataaattagcactgatggggtggagtaggttgtactgcatgaggaaatgcaggcattttgttcattagtgagatacttctagcttttaagagtacaagaaactaaggagagcttgggaagaggtggtggtgaatgctggattcattctgcaatatcctcgtctcgagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgct

SEQ ID NO: 19122 - DNA, 4129 bp, Homo sapiens
  ENST00000537413
attgtaaactttactggacacaactgatggaagctaaaatcagtgaatgactgtttcaggagaaatgggaggagaagcaggatttgcatgatctccagaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtag

SEQ ID NO: 19123 - DNA, 785 bp, Homo sapiens
  ENST00000555066
gaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggtggatctgcctatatttatatgcatcgtattacctgccttcacagctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctc

SEQ ID NO: 19124 - DNA, 1136 bp, Homo sapiens
  ENST00000554960
gagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggtttggagtgagccgtagatccccagcctccattgacaggcagaacacccagtcagatattggtggcagcggaaaatccacgcctagctggcaaagaagtgaggatagcattgctgaccagatggcttacagttatagaggacctcaggatttcaattcttttgtcctcgagcagcatgaatatacaggtaaaatatttccaaagtgtcatggtaagtaacacgtgattgcatccatgcctgtctaggtaatgtagaccaagctaggttagccacacttggcaatgaatgaatttcataaatttaattcatataatctaaatttttcccccaaaccaaaagttgattctgaactttgctgcgttgttcatggcctttggtttggtggtacttggctatgctaatgtgtatgacgtgacaagttgtcaccagctgcaagctttatccatcagccacttaagtttctgacctgctgtctatcaaatagactcttaacaagcttactgctgaaatgcagagtttgctggtcagtgaactgaaagatgcaatggcaagccatcttcatttgtcaccatgtgcttgtttctgcttagtgcctgcaccataatgtcctatgctgtattccagagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctata

SEQ ID NO: 19125 - DNA, 2106 bp, Homo sapiens
  ENST00000554874
cccaggactgccttcccctcatgggtaaggtccctgatgttgtctttgcctttgcggaaatcaccacaggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataa

SEQ ID NO: 19126 - DNA, 574 bp, Homo sapiens
  ENST00000556959
ggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcaggttggtcccagtgcaagggcagtactctgcaccttgtgtcacatctgccactgactgcatctgtggggagaagagatggaagccacacggagtagctgagtgaagctgatcactgcagggctagacactttacattttagtcagaacgctttgtaactgaatactgtagacataattaaactattcttgatgacttatacgg

SEQ ID NO: 19127 - DNA, 6690 bp, Homo sapiens
  ENST00000366630
actaggggtgggcattgtgtgtggctcccctgtggtagagaaggacatcggatgaacatgtgatctgtgtatccagctccaacccaaaaggtgaaggaaatactcatgaccagccagatgtcttaaggaatgcttttgaaaagaacagaggcgtacaacattattacgacaacagagaagcaagttggctttgaagaaactgtattctgaggatgttgtttgctttgggctaagaaaagaaaaaatacaactacagacaaagcctttatatctgcaagtattatggcgtggtcggtagcaatgtaattagatttacatcagtcttcctggtgagacttggaggctcttcctcggtagacatgagtgacccaaggcagtcacaagaagagaagcacaagctaggcagagcctcttcaaagttcaaggatccccctagaatcatgcagtcagatgattattttgctcggaaatttaaagccattaatggcaacatgggacccactacttctttaaatgcctcgaattccaatgagactggcggtggtggtccggctaatggtaccccagctgtgcccaagatgggtgtgagagcaagggtgtctgaatggcctcctaaaaaggactgttccaaggagctaacatgcaaggcactgtgggaaagccggtctcagaccagttatgaaagcatcacttctgtcctgcagaatgggcagagtgaccagagtgaaggtcagcaagatgaacagctcgatctggacttcgtggaggccaagtacacaatcggagacatctttgtccattccccccaaagaggacttcaccccataagacagaggagcaatagtgatgtcactatcagtgacattgatgccgaagatgtcttagaccaaaatgcagtcaaccccaacaccggggctgccctgcacagggagtatggaagtacttcatccatcgacaggcaaggcttatctggtgaaaacttttttgctatgctcagagggtaccgagtagaaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataagaaa

SEQ ID NO: 19128 - DNA, 2937 bp, Homo sapiens
  ENST00000308942
acttactgtcataggtcttattaaataggtatctatgtagtcagagcatgtttcatagaaatggagtgttcattaaactgaaacttcatacattgcctctgggcttttggggataggagtatgatacctcccaacttgaaattcccacagataggtgaggtcatagtcatcgggtgatacttaatgagcccatgtttttctttcattggatgtaaactatgctcgatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaac

SEQ ID NO: 19129 - DNA, 511 bp, Homo sapiens
  ENST00000486472
agcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaaggggtgtgtataatgtgagattgtatgtttgtgtgtgaatttgtgtctgtttctgaaagttttggagttttcccatccatctttcttgtaagatcatttattttaaatgccttagaacattttctctttagtttttcccaaatatgtttttatactagtttggaaacatgatgccattatagtataacaca

SEQ ID NO: 19130 - DNA, 416 bp, Homo sapiens
  ENST00000495863
gggagggacagtggtgcccgtgttctgactgactctgggagggacagtggtgcccgtgttctgactgactgactctgggagggacagtggtgcccgtgttctgactgactctgggagggggcagtggtgcccgtgttctgactgactgactctgggaggggcagtggtgcccatgttctgactcactctgggctggtgcccgtgctgtgactgatgactgactctctggttttgtttctgtttagatgagttctggttctccgatgggtccttatcagataagtccaagtgcgcagatcctggcctgatgcccctcccggacacagccacagggttagattggacccacctcgtggatgctgcacgggcatttgaagaccagagggtggcatccttctgcaccctgacagatatgc

SEQ ID NO: 19131 - DNA, 507 bp, Homo sapiens
  ENST00000494056
catttgggtcttccttgtctccattggataaaccaacttaaataatatatcttttgttttcctaccaactcgtatatctatagagtttctgcatctctttttaaatcagtaaagtcccagaatgggctttccactagatcagcaatatggacactttcccattctgacataatataatatatctgcttgctgggctctaagcacatgaaataattttttcgagtgaaaacttgaccaacaaaaatgctcgattgactctcttgaatctttctaattctatccttatttgctagggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatc

SEQ ID NO: 19132 - DNA, 6555 bp, Homo sapiens
  ENST00000262861
cttttgaaaagaacagaggcgtacaacattattacgacaacagagaagcaagttggctttgaagaaactgtattctgaggatgttgtttgctttgggctaagaaaagaaaaaatacaactacagacaaagcctttatatctgcaagtattatggcgtggtcggtagcaatgtaattagatttacatcagtcttcctggtgagacttggaggctcttcctcggtagacatgagtgacccaaggcagtcacaagaagagaagcacaagctaggcagagcctcttcaaagttcaaggatccccctagaatcatgcagtcagatgattattttgctcggaaatttaaagccattaatggcaacatgggacccactacttctttaaatgcctcgaattccaatgagactggcggtggtggtccggctaatggtaccccagctgtgcccaagatgggtgtgagagcaagggtgtctgaatggcctcctaaaaaggactgttccaaggagctaacatgcaaggcactgtgggaaagccggtctcagaccagttatgaaagcatcacttctgtcctgcagaatgggcagagtgaccagagtgaaggtcagcaagatgaacagctcgatctggacttcgtggaggccaagtacacaatcggagacatctttgtccattccccccaaagaggacttcaccccataagacagaggagcaatagtgatgtcactatcagtgacattgatgccgaagatgtcttagaccaaaatgcagtcaaccccaacaccggggctgccctgcacagggagtatggaagtacttcatccatcgacaggcaaggcttatctggtgaaaacttttttgctatgctcagagggtaccgagtagaaaattatgaccacaaagcaatggtcccttttgggttccctgaatttttccgctgtgaccctgcaatctctccgagccttcatgcagcagcacagatttctaggggagaatttgtccgcatctcaggattagattatgtggacagtgccctcctgatggggagagacagggacaagcctttcaaacggaggttgaaatcagagtcggtggaaacatctctcttccgaaagcttcgaactgttaaaagtgagcacgaaactttcaagttcacgtctgagctggaggagagccgactggagaggggcattcgcccttggaattgtcagcgatgttttgcacattatgatgtccagagcattttgtttaatatcaacgaagccatggctacgagggctaatgtggggaaaaggaaaaacataaccactggggcatctgcagcatcccagactcagatgcctacgggccagacaggcaactgtgagtcccctttagggagcaaggaggacctcaactccaaagagaacctggatgccgatgagggtgatgggaaaagtaacgacctcgtccttagttgtccttactttagaaatgagactggaggggaaggcgacaggcggattgcgctctctcgagccaactcatcctctttcagttctggggaaagctgctctttcgaatcgtcactcagctctcactgcacaaatgcaggtgtctccgtcttggaagtgcccagagaaaaccagcctattcacagggagaaagtgaagcgctacatcatagaacacattgaccttggggcctattattaccgcaaattcttctatgggaaagagcaccaaaactactttggaatagatgaaaaccttggtccagtagcagtcagcatccggagagagaaggtggaagatgccaaggagaaagaaggatcccagttcaactacagggtggctttcaggacaagtgagcttacaacactgagaggagcaattttagaagatgctataccctctactgctaggcatggtaccgcacgaggactacctctcaaagaagttttggaatacgtcattccagagctgagcattcagtgtttgcgacaggcttccaactcacccaaggtctcagagcagctgctcaagcttgatgaacaagggctgagctttcagcacaagatcgggatcctttattgcaaagcaggccagagcacagaggaagagatgtataacaatgagacggcgggaccagcttttgaagaattccttgatcttctgggccagagagtccgactgaaaggatttagtaaatatcgagctcagctagacaataagactgattccacgggcacgcactctctctataccacatacaaagactacgaactcatgttccacgtgtcaaccctgcttccctacatgcccaacaacagacaacagctactgaggaaaaggcacataggaaatgacatcgtcaccatcgtcttccaggagcctggggcacttccttttactccaaaaagcatccggtctcactttcagcatgtctttgtcatagtcaaagtgcataatccatgtaccgaaaatgtgtgttatagtgttggagtttccagatcaaaagatgtgccaccatttggcccaccgattcccaaaggtgtaacttttccaaagtcagccgtgttccgggacttccttttagccaaagtaatcaatgcagaaaatgcagcccataaatcagaaaagtttcgagcaatggccactcgaacgaggcaggagtacttgaaagatctggcggagaactttgtcacaaccgccaccgtggatacctctgtgaagttcagcttcattacgctgggtgcgaagaaaaaggagaaggtaaagccaaggaaggatgcccacttgtttagcattggggccatcatgtggcacgtgatagcccgggacttcggccagtctgctgacattgaatgtcttctcgggatctccaatgagttcatcatgttgattgaaaaggattccaagaatgttgtattcaactgttcctgcagggatgtgattgggtggacatctggattagtgagtatcaaagtgttttacgaaagaggagaatgtgtcctcctgtcctcggtagacaactgtgctgaagacatcagggaaattgttcagcgattagtaatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctgacccacgagcagatgatcgacctgctccgtacttctgtgactgtgaaggtggtcatcatccagccccatgatgacggctcgccccgaagagggtgttcagagctctgccggatccctatggtggaatataaactcgacagcgagggcaccccctgcgagtataaaacccccttcaggaggaacaccacgtggcaccgggtgcccactcctgccctgcagcccctctctagagcttcccccatccccggcacgcccgaccggctgccgtgccaacagctgctccagcaggcccaggctgccattcctcgaagcacctccttcgaccggaagctgcccgatggcacgagaagctcacccagcaaccagtcatcctccagcgaccctggacccggcgggagcggaccctggagaccacaagtgggctacgacgggtgccagtcccctctactgctcgaacaccagggctcaggccctttggaatgtgacggagccagggagagggaagacaccatggaagcaagcaggcacccggaaaccaaatggcatggcccaccttccaaagtcctgggttcctataaagaaagagctctgcagaaagatggaagttgcaaagattcccccaataagctttctcacattggggataaaagttgctccagtcactccagcagcaacacgctctccagcaacacctccagcaacagtgacgacaagcactttgggtctggcgacctgatggaccccgaattactggggctgacctacatcaaaggggcctccaccgacagtggcatcgacacggccccctgcatgcctgccaccatcctcggccctgtgcacctggcaggcagcaggtccctgatccacagccgggccgagcagtgggctgatgctgccgacgtctctgggcctgacgacgagccagccaagttatattctgtgcatggctacgcgtccaccatctccgccggcagtgctgcggaaggcagcatgggcgatctcagtgagatatcctctcattccagtggttctcaccattcaggaagcccttcagctcactgttcaaaaagtagtgggtctctggattcatccaaagtctacatcgtgtctcacagcagcggacaacaggttcccgggtccatgtccaagccctaccacagacaaggggcagtgaacaaatatgtcatcggctggaagaaatcggagggcagcccaccgcccgaggagcctgaagtgactgaatgtcccgggatgtatagtgagatggatgtcatgtccacagcaactcagcatcagacagtggtgggagatgctgttgcagagactcaacatgttctgtctaaagaagattttctgaaattgatgcttcctgacagccccttagtggaggaggggcgaagaaagttttcgttctatgggaacctgtctccaaggaggtcgctttaccgcacgctgtctgacgagagcatctgcagcaacaggagggggtcctcctttggcagttcccggagttccgtgcttgaccaggccctgcccaacgacattctgttcagcaccaccccaccctaccacagcacgctgcctccgcgggcccaccccgcacccagcatggggagcctgagaaatgagttctggttctccgatgggtccttatcagataagtccaagtgcgcagatcctggcctgatgcccctcccggacacagccacagggttagattggacccacctcgtggatgctgcacgggcatttgaaggtcttgactcagatgaagaactggggctgctctgtcaccacacgtcctatctagaccagagggtggcatccttctgcaccctgacagatatgcagcatgggcaggacctggaaggggcccaagagctgcccttatgtgtagatccaggcagtggcaaagagttcatggacacaactggggagcgttctccatcaccactgaccgggaaagtcaatcagctggaattaattcttcgacaactccagaccgaccttcggaaggaaaaacaagacaaggccgttctccaagcagaagtgcagcacctgagacaggacaacatgagactgcaggaggagtcccagaccgcgacagctcagctgcggaaattcacagaatggtttttcaccaccatcgacaaaaaatcttagccaatccgcacctcatcaagggaccactgggaaatgccccttgtccctttgaagtcacaaacatgtggtttttctgtgtgctttcaaccaatcgtagatgtttttgctgttccattctgtgtagcaccattcaccacagcaggatagggagcctcgactctttctcggtaaccacggcagagagcagcgccgatgtgaagatgaatgaatgtaactcctggtgtgaagatgaatgtaaaccctggcgacagttgagacctttttcttttagactctgctaaaacagtgctctggcttgggcttacctcaagagggaagatagttgagttttatttcctgtatatcaggtgacctggtagagatgtaaagcaatttaccatagtttgggctttagtattgtaaaataaacatgagaacaaataatcagacatatactttaatgttaaaggtgctctatttttttggatgtacagtagttttatttccacagccacattaccatagcaataagaaaggaggcatagtacatagttggaaaagctttgtggggggattaaaaaaaaaaaaaagcactgttgtgtttaacactagttcagatgcagttaccttagagacttatttatttgcaggaacaaatggtgcctgaatattaacagtgttctgattaaaaacaaaaaaaagatacatatgccttgtaaatggctcaccgagtggtcagtagtcacttcaactcttagttcacttttgtatagttgctctgctggaaagaaatgagagtgaatctgcttactcactagaacttccctgtgtgctgtgagccagcggaaccacttgtacaatgccagatttgtttatctttgtacagaagctttgatgaagtgtcttgtatttaacacccttatttaagcttatttaaccttaaattgttaattttataaaatttggtttggcctgcactacgatgagggatggaggtagctgcaggctcagaagagactgagcttgcacagatcagaccgagaagcagggtgagagattctaacgactggatgctgctagtaacacattgtttgtattgctttaccatttttaactgttagatttgagatgaacatacattttgcttttttaataaatgtttaaaagaagtccacataag

SEQ ID NO: 19133 - DNA, 7987 bp, Homo sapiens
  ENST00000222345
cgcgaagcggcttggaagtgggcagcctggaagtcactcgggccaccggagctggcggcgtctccagcgagcggcgcggagctggacgccgcgatcgtggggcccgcgaggcgggcagccggggcgtccagatgcacagtctctgacatcagctctcctgggaccctccaagagcactagtgtctagaaggcactaaggcatggcgaggacaacatccttgctgcctccagctggcgggcgaccacagctactgcctgctctgcgctactgagccactcggtctggagcccccaggacagcacctgcttcctgaggttgtcctggctcagctgtgcacagcgatggtggagaactggactccacaggctcacaaccttcctgtcaggtttcagggcccagcatccttcatcctgggcctggctgccctgaacaatggctgagggctgggggaccccatagagtgacaccacagcgtacggggccagcagcactccagtgcccgtggactatgaccacctatcgggccatccccagcgatggtgtggacctggcagccagctgtggcgccagggtgggcgatgtcctccctgggccacacacaggggactacgctcccttgggattctgggcccagaatggcagcatgtcccagcctcttggcgagagcccggccaccgccaccgccaccgccaccgccaccacccgccccagccccaccactcccgcaatgcccaagatgggcgtgcgcgcaagggtggccgactggccgcccaagcgggaggccctgagagagcacagcaacccaagcccctcccaggacacagatggcacaaaggccaccaagatggcccattccatgaggagcatacagaacggacagccccccaccagcaccccggcttcctcagggtccaaagccttccaccgactctccaggagaaggtccaaagacgtggagttccaggacgggtggccccggtcccccggcagggccttcctcccccttcggcaccgcagcagcagcgagatcaccctcagcgagtgtgacgcggaggacgcgggggagccgcggggggcccggcacacgggggcgctgcccctcttccgcgagtacgggagcacctcgtccatcgacgtgcagggcatgcccgagcagagcttcttcgacatcctgaacgagttccgcagcgagcagcccgacgcccgagggtgccaggccctcaccgagctcctccgggcagatcctggcccacacctcatggggggcggcggcggagccaagggggactcccacaacgggcagcccgccaaggacagcctcctgccactgcagcccacgaaggagaaggagaaggcccggaagaaacctgcgcggggcctcggcggcggggacacggtggactcgtccatctttcggaagctaaggagcagcaaacccgagggggaggctgggcgttccccgggggaggccgacgagggccggagccccccggaagccagcaggccgtgggtgtgtcagaagagcttcgcccacttcgacgtgcagagcatgctgttcgacctcaacgaggcggccgccaacagggtgtcggtgtcgcagcggcggaacaccaccacgggtgcttcggccgcttccgccgcctcggccatggcctccctcacggcctcgcgggcccacagcctcggaggcctggacccggccttcaccagcacagaggacctaaactgcaaggagaacttggagcaggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaagaacatgccaattacttcggcgtggatgagaagctggggccagtggctgtgagcattaagcgggagaagctggaagaccacaaggagcacggacctcagtaccagtacaggatcatcttccggacccgcgagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagaccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggcctgtcagcttcccagaaaccccttacacagtatcaccagcaggggccgacagagtccctccctaccgacagccttctgggagcttctccacccccggttcggccacctacgtgagatacaagccatccccagaaaggtacacggctgccccacaccccctgctatctcttgatccccacttcagccacgatgggacgtccagcggcgactcctcttccggcggcctgaccagccaggagagcaccatggaacgccagaagccagagcctttgtggcatgtgcctgcccaggccaggctctcagccatagccggaagcagcgggaacaagcacccgtccaggcaggatgcagcaggcaaagattcccccaacaggcattccaaaggagaacctcaatactcaagtcattccagcagcaacaccctctccagcaacgcatccagcagccacagcgacgaccgctggttcgaccccctggaccccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggacagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaagtgcaaagagccgtctcactcttctctctgaacgacccggccctgagcccggacatcccgcctgcacacagtcctgtccacagccacctgagcctggagaggggacccccgacccccaggaccacccctaccatgagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcgcacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcaccaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaaggtttcatagaaatgg

SEQ ID NO: 19134 - DNA, 545 bp, Homo sapiens
  ENST00000599644
gtgggcagcctggaagtcactcgggccaccggagctggcggcgtctccagcgagcggcgcggagctggacgccgcgatcgtggggcccgcgaggcgggcagccggggcgtccaggcgtgcaccccggcgctgtggtgaagagcttggaggcggggagcggtggattcgcgtcccggctgtgccactcgggagccgcgatctgggaaaaccgcgccgaacctcaatttcccctgcagtaaaacggagtaggagagcatcttggcggagactctgttgagataatataataaaacatttggcacataggaggcacttactacgtatttgggttattgttagctctccgaaaaatgaggtgaagatgttatcgattgcatagggtgaggattagttgagcgtgtgcatgtaaagaggtgagtccttagttagcacccaatgcaggctagctgctgttaaccgagattattttgttaagagcgttggtttggaaggcagagagaccccaggttcaaatttgaacatttaccagctgtgtgactttgggc

SEQ ID NO: 19135 - DNA, 608 bp, Homo sapiens
  ENST00000476317
gaggccttttctttccctcccccaaagggaatgttggcaaaacagctttctttgggaacgcgcctgttcacgacgaccagccatctcctggggaactccggtggctggctggcgtgttcctgcggctgttgaataagtcgctgttaggagctggcacggcaggttcccgtttccgcattccaggcacccacagcgggctgggggcgggcaccactgaggtcggcctggagagccaaggcaggtggcctcgccctgggaggaccagggacaggaggagtccacctggggctcccctgacagccacctgcccactttgtgatcagagccgtgttcggggagtctttcagatgcacagtctctgacatcagctctcctgggaccctccaagagcactagtgtctagaaggcactaaggcatggcgaggacaacatccttgctgcctccagctggcgggcgaccacagctactgcctgctctgcgctactgagccactcggtctggagcccccaggacagcacctgcttcctgaggttgtcctggctcagctgtgcacagcgatggtggagaactggactccacaggctcacaaccttcctgtcaggtttca

SEQ ID NO: 19136 - DNA, 163 bp, Homo sapiens
  ENST00000595982
cgcctgtaatcccagcactttgggaggccgagaacatgccaattacttcggcgtggatgagaagctggggccagtggctgtgagcattaagcgggagaagctggaagaccacaaggagcacggacctcagtaccagtacaggatcatcttccggacccgcgag

SEQ ID NO: 19137 - DNA, 785 bp, Homo sapiens
  ENST00000595384
catcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaagggctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagatagagacggggtttcaccatgttggccaggctggtctcgaactcctgacctcagatgatccacctgcctcagcctcccaaagtgctgggattataggtgtgaaccaccaggcctggccagtgtatttaatttttaagagtagattgaagtgaaagcaccaagttaaaaaccagcacagatggtacgtgggatatggcaaaaacccagaggttttggaaacatggtcctaactggcatttctgtttcagccgactccacgggaacccactccctctacacgatgtaccaggactacgagatcatgttccatgtctccaccctgctcccttacacccccaacaacaggcagcagctgctacggaagaggcacataggaaatgacatcgtgacgatcatcttccaggagcctggcgcgctaccgttcacccccaagaacatccg

SEQ ID NO: 19138 - DNA, 546 bp, Homo sapiens
  ENST00000601222
ttgagtacctcctgtatgccaggcactgtgctgggtactgaggatacagcagttggccgtgaacaaaatccctgttctcatggagctgccacttcaatgggaagagacaagaaacaaaatgaagtggggaaagccatctctgctgagtgtcaataagtgttaagtaatggggacagaaaagcaaagatcagggagtgttgtggtggggtggatctgaataacgtagtcagcaaaggcctccctgggagggtgaggtttatgcaagaccagaagaggtgacgaaggaagccatgtggggactcaggaagaatgttcctagcagagggaacagcggtgcagaggcttcgaggaagtgtttctggccatggtgaggcctttgtcctttatcctgaatgagagggaaccacaggaagctgctacggaagaggcacataggaaatgacatcgtgacgatcatcttccaggagcctggcgcgctaccgttcacccccaagaacatccgctcccacttccagcacgtcttcatcattgtccgagtccacaacc

SEQ ID NO: 19139 - DNA, 374 bp, Homo sapiens
  ENST00000594553
cctgtccccctctgttgccctttcccagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaagg

SEQ ID NO: 19140 - DNA, 568 bp, Homo sapiens
  ENST00000601881
gactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggtaagggcctccacctttcagccaggtggtgggtggcagctcccagatcgctggcatga

SEQ ID NO: 19141 - DNA, 407 bp, Homo sapiens
  ENST00000600919
cgacagagggttctgtggaggacataagggagatagtgcagagactgaaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggagatggagtctcgctctgtcgcccaggctgaagtgcagtggcgtgatctcaactcactgcaacctccacctcccgggttcaagc

SEQ ID NO: 19142 - DNA, 584 bp, Homo sapiens
  ENST00000595495
acaggcggcgggaggtctcccctgcccccgcagttgccggccaaagcaagggctaccgaccgaagctgtactcctccggctccagcacccccacgggactggcggggggcagccgagacccaccgaggcagcccagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagtaagtgcctggacgtccagcgaggcgcccgccagatccacaccagggcgtctccggggcggaaagagggtgatgccacatgctgtcattgcacagacgactgtgggccagtgtaccagtgtacacactggggctgcagctgcaagcaggacaggcgagaacccctcttggggagctggcattccatttggggtgaccaacaataagtagaataagagaagcacgc

SEQ ID NO: 19143 - DNA, 572 bp, Homo sapiens
  ENST00000601054
gcgccaggagtccctgggatgcccttctggggacacagccctgaaagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggatcaccgcagaagggcctgcagcggacgctgtcggacgagagcctgtgcagcgggcgccgggagcccagcttcgccagccccgctggcctagagccagggctgcccagcgacgtgctcttcaccagcacctgcgcctt

SEQ ID NO: 19144 - DNA, 811 bp, Homo sapiens
  ENST00000596403
tgttggtcctgcccacaagggcaggtccttttgaccatctgtccattctcgtgcttcctgtgcctggacccgccaggtgctcagcaggtgtctgtagagtgggctctttgtatcctggaggtacgaagaaggggtcctccctgaagtcacatgcacggcccagcctcagggaaaacgcacacttaagggtgggcagccacccttcccctggcctggtgctcctaacaccccgtccacatccacagaggtgcccttggtgggtggagtgtgccgggtggagggctggcttcctgcttcccctcagagcttctcctcaggctttgctagaatgtcagggataagggggcctgtacccccaggctcctcagatgtgggccagaagccttccccaggggctttagggcctcaggctgaccttgtccctggtttttccagcgaggagccacccctggatctgacaggcaaggtgtaccagctggaggtgatgctgaaacagctgcacactgacctgcagaaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcacta

SEQ ID NO: 19145 - DNA, 4570 bp, Homo sapiens
  ENST00000622179
ggcggcgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggtacagtccttggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtccttccggtgttcagtattcttgtctttgtgagtgcgtcccggggccgcctcggggcctgcctgccctcctgccaaagcctggaagaggattgaatggaccccagggtttggaaacaacctacagcatttgagcccctcacgtaggttttagagacgtacaatttttgtttgccctggctcagaaggagccggtgtaaggttgagataaaattccatatagacaactgagtttggatctcggctctgctgctttgtagctgtgggagttcaaacagcacctctttgagacttgggccccgcgtcggcacaatggggcaggaatagtccctgccagggtgactgtgtggattcaaggaggttggaagcactgagcccacgcttggcactgggtaggccatcactgaggcttgtgtctttccttcctgccctgaccctgcatagctgagtctcgtggcctctcaccactgatgggatctcggacacccggctcaccctcctcctggggcctcactttccttccccaccaaatgcagacatctaatgcttgtcctgtaatatccttgccagatgactgatgtcaagtgctggtttatagtgggtgctcaataaatgttagtttcctttctatccctccattagatcattaatgatattagtgctaattatgtaataaagttaaggcataaatatgttaa

SEQ ID NO: 19146 - DNA, 3867 bp, Homo sapiens
  ENST00000356025
cgctcgcagagaagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtc

SEQ ID NO: 19147 - DNA, 3996 bp, Homo sapiens
  ENST00000358771
gcggccgctccaggcgcccgttccggagtcggggggaggcccagccgggaggggggaagggggggagccttagtcatttccccgctccagcctgctcccgcccgagcgcgcactcacggccgctctccctcctcgctccgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtc

SEQ ID NO: 19148 - DNA, 4201 bp, Homo sapiens
  ENST00000400068
tccggcccgcacccacccccaagaggggccttcagctttggggctcagaggcacgacctcctggggagggttaaaaggcagacgcccccccgccccccgcgcccccgcgccccgactccttcgccgcctccagcctctcgccagtgggaagcggggagcagccgcgcggccggagtccggaggcgaggggaggtcggccgcaacttccccggtccaccttaagaggacgatgtagccagctcgcagcgctgaccttagaaaaacaagtttgcgcaaagtggagcggggacccggcctctgggcagccccggcggcgcttccagtgccttccagccctcgcgggcggcgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatga

SEQ ID NO: 19149 - DNA, 6285 bp, Homo sapiens
  ENST00000216513
ggaaagaaagaggaaaagagtgcgagggagtgagggagggaggaaaataaacaacaaaaaatgtcctcttcctcccccaccgggcagatcgcaagtgcggcggacatcaagcaagagaatgggatggaaagcgcctcggaagggcaggaggcgcaccgagaagtggcggggggcgcggcggtagggctgagccccccggctccagccccttttcccctggagccgggggacgccgcgaccgctgccgccagggtgagcggagaggaaggggcagtggcggcggcggcggccggagcggcggcggatcaggtacaactccactcggaacttctgggcaggcaccaccacgccgccgccgccgccgcgcagaccccgctggccttctcgcccgaccacgtcgcctgcgtgtgcgaggcactgcagcaggggggcaacctggaccgcctggcccggttcctgtggtccctgccccagagcgacctgctacgtggcaacgagagcctgctgaaggcgcgggcgctcgtggccttccaccagggcatctaccccgagctctacagcatcctcgagagccacagcttcgagtcggccaaccacccgctgctgcagcagctctggtacaaggcgcgctacaccgaggccgagcgagcccgcggccggccgctgggagccgtagacaagtaccggctgcgcaggaaattccccctgccccgcaccatctgggacggcgaggagacggtgtattgtttcaaggagaagtcgcgcaacgcgctcaaggagctctacaagcagaatcgctacccttcgcccgccgagaagcggcacctggccaagatcaccggcctctccctcacccaggtcagcaactggttcaagaaccgccggcagcgcgacaggaacccctccgagacccagtccaaaagtgagtcagatggcaaccccagcactgaagatgaatccagcaagggacatgaggatttatctcctcacccactctccagttcatctgatggcatcaccaacctcagcctttccagtcatatggagccagtatatatgcaacaaattggaaatgctaagatatcattaagctcttctggagttctgttgaatggaagcttggtacctgcaagtacttcacctgtcttccttaatggaaattcttttattcagggacccagtggagttatccttaatggattaaatgtgggaaatacacaggcagtggcattgaacccaccaaaaatgtcatcaaacattgtgagcaatggtatatccatgactgacatactggggtctacttcccaggacgtgaaggaattcaaagtcctccagagttctgctaactcagcaaccaccacgtcctacagccccagtgtccctgtctcattcccaggcctgatacccagcactgaggtgaaaagagaaggcattcaaacagtggcttcccaagatggagggtctgtagtgacttttactacaccagtgcaaattaaccagtatggcattgtccagatccccaattccggagcaaacagccagttccttaatgggagcattggattctctccactgcagctgccccctgtgtcagtggcagcttcacaaggtaatatctcagtaagctcaagcacttcagatggaagcacatttacaagtgagtctaccacagtccagcaaggaaaggttttcttgagctctcttgctcccagtgcagtggtatacacggttcctaatacaggccagactataggatctgtgaaacaggaaggcttggaaaggagcctggtattttctcagttgatgcctgtcaatcagaatgcacaagtaaatgcaaacctgtcttctgaaaacatctcggggagtggcctgcatccactggcctcctcattagttaatgtatctccaactcacaatttttctctcagtccctctacactactaaatcccactgagctaaaccgcgacattgccgatagccaaccaatgtctgcaccggtggcaagcaaatctactgtgacatctgtcagcaacactaactatgcaactcttcagaactgctcccttattactggtcaagacctattgtcagtccctatgactcaggctgcccttggggaaatagttcctacagctgaagatcaggtaggtcacccctccccagcagtacatcaggattttgtccaagaacatcgtttggttctgcaatcggtagctaacatgaaagagaatttcttatcaaattctgagagcaaagcaacaagtagcttaatgatgctggactctaaatccaagtatgtcttagatggcatggttgatactgtctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtttttgtttacttttactccatgggcattgaaaaggttaagaaacataaatggtacatatttttaaagttaagtagcatgcatatatatatgcacacacacctctttttcagcattttttgagaaagtcttgggtctcaaacacatttgtctcaacacatttccaaatgtgatttctaatagctcagtgtggctgagaaagtgcggaactccactaaaaactctgaaacttcagtataaatgtaaatatatcagttctataagcaggatttgagtaattacagtgaattttatttttaatgtatatgtttctcttcaggcgctatgaactgaaaaatatgttttcttactgtttaatttatttttattgtttgaacaggaagtgaacatagtcgtttccaacaaagttttactttttgtaggattttaaaaataatgatttttaccaggaatctattaaggtcaatattaataacactgaaacaggaaatctaactcccaatattggaattttggtactttttttcacatccttgttctttatttagcaactctgattcatttaaatatgttttttatagaattctatgtgcctttttacctcgtggcctttttattggtagtaaggtacagaagtgtcaacagaagcactgatggttcttttctactatctaacagggttaatttcaccacaaaattgctttaaatctgaagaacttaagtttcactaaataatatatatgacatttatcacacaaatggataaacaactaattattgttgatacttttcattacaaggaaaataagttataaataccatgtcaaattgattatacaggctatgaaaaccattttaaaggaaagaaaatatgtaaattctattgagcaaaattctgtcctgttgaaacttagttctaaaggttttgaatcagttgttacactctgacacatgactgttgtttgcactatattatcatgtcttctttaaaagtaaatatttttggtttctgtaagaagcttgtttaataatgttgtaagccgtggctatagttttatcaagactctgaacacaagatgtaacaatgcaaataaatttatgtagtgagtaaagttgctctctagtctctgaaaagcaaaaaaagtgagaaaataatttcttcagagataacttcaagttgttgaacataaaggtgttagatgttagcacatcttgctttttttttttttttgagatggagtctcgctctgttgcccaggctggagtgcagtggcacgatcttggctcactgcaagctctgcctcctgggttcacgccattctcctgcctcagcctcccgagtagctgggactacaggcacctgccaccatgcccggctaaatttttgtatttttagtagagacggggtttcaccgtgttagccaggatggtcttgatctcctgacctcgtgatctgcccgcctcggcctcccaaagtgctgggattataggcatgagccactgtgcctggccacatcttgcttttttttttatgatcagaacaaagggcccactctagttctctacatgtcaatcaatcaagcatgttgaataagggacatagaggatttaacttttgttatcataaatggaacttgcaggcatatatcaagaaccctatgaagaattcctctcccatcattttgataaagaactacatcatttttgatagaattggtgaatgttcctaaactgctgaagctacatgttttttgttttgttttacaaagtcaggtgtttgagagttcttttccactctactactactcatagagcttgttttttctttgggtgtgtgctgatcctgttactgagattaattacatggctctgcagtgtagtttacataaaaatgatgttttccacttgattgctgcagatatcaagagtttgttattttcaaatacccatccaacaagagagatggggaggtttttagttatatatgctatatatatatatataactggaaatgttttatatgttttccgaaaatacaataagcctctcttttattcagtgttcttcctcttttctcccttatgaaaaagaaaagatagcacaaaacttaagacttacctaggaaacccattcatattcccaccatgatgtaattataaccctacaattacttcaggtagctacacaatataccaggtaagaatcaatgcacagtataaagaacttattgttcttttctattctttcagttgaataagggccagttggtatgcagcccatgtatatgtgaatggagtaagataaaccccatgatctccttgcacagaattgcaaatgtcttttgccataccaagggccagactcagaacccttggagtcatgtggcagaatttccctcttacataaaccaatgcttgaaaatgctgcaaatgaccctctaatgatccctgaagatcaaaacaggggtaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcagtgcctttcttgtgttatgaaaggcaggtagatattatagccataggtaaaaatccatagttaaattgcacactgaccttaaatctctctgtgtatgcccttgtatcttgcatgttaaaagttggattattgggcatgtgtggcagcctgccctgctacatgctagacaagtgtgctttagtacatagccacaagttcttcattctttaaaatgttttgacagatcatctcataataaaaataattcaggaaaactatggggaaatagttacatttcacaaaagatattttaaactctttgtaaaacttagataatagagcctagcagttactttgtatctaattgatacattttatgttaatttaccaccatacattttattaatcaaaattgtatagcatgtgactcttttggctttcagagttctcaaaaatattattttgttgcatgtactgtatgtttagaggcaaccaattatatactcaatatggttttactgtgccttacacaaagagaaactctatacagaatgtatatcatggggtggggtaacagagtctttactgcactgttaggtgatggcacacagagcatgtcccagaacatttctgtgcttaattacccaaccaaagagatctgaagtatgtatgtcgtactgtaatgggggtttatgcctggacaattaagtgttttatttgttttctgaaatgatgtgaacttatttttctaaacactatgctaaataaactttatatttatacataccttgcattga

SEQ ID NO: 19150 - DNA, 2003 bp, Homo sapiens
  ENST00000554079
cttcccggctttcttttcctccaagtgctcgcaaacatggcgcttaccttccccaccagcctggtccggctgcccacctctccccgccccctacctcgctccccggccggcagagggcactggatggtgtttgttaaataggcccctttggcttcctttggattcaaaggcgactgcacataactgttcttgggttgaaagtgccttttcctacaacaaggacagccactttgttgaatgagagagttgtcagtctggtggagtagaagtttgggagcagtgagtcagatggcaaccccagcactgaagatgaatccagcaagggacatgaggatttatctcctcacccactctccagttcatctgatggcatcaccaacctcagcctttccagtcatatggagccagtatatatgcaacaaattggaaatgctaagatatcattaagctcttctggagttctgttgaatggaagcttggtacctgcaagtacttcacctgtcttccttaatggaaattcttttattcagggacccagtggagttatccttaatggattaaatgtgggaaatacacaggcagtggcattgaacccaccaaaaatgtcatcaaacattgtgagcaatggtatatccatgactgacatactggggtctacttcccaggacgtgaaggaattcaaagtcctccagagttctgctaactcagcaaccaccacgtcctacagccccagtgtccctgtctcattcccaggcctgatacccagcactgaggtgaaaagagaaggcattcaaacagtggcttcccaagatggagggtctgtagtgacttttactacaccagtgcaaattaaccagtatggcattgtccagatccccaattccggagcaaacagccagttccttaatgggagcattggattctctccactgcagctgccccctgtgtcagtggcagcttcacaaggtaatatctcagtaagctcaagcacttcagatggaagcacatttacaagtgagtctaccacagtccagcaaggaaaggttttcttgagctctcttgctcccagtgcagtggtatacacggttcctaatacaggccagactataggatctgtgaaacaggaaggcttggaaaggagcctggtattttctcagttgatgcctgtcaatcagaatgcacaagtaaatgcaaacctgtcttctgaaaacatctcggggagtggcctgcatccactggcctcctcattagttaatgtatctccaactcacaatttttctctcagtccctctacactactaaatcccactgagctaaaccgcgacattgccgatagccaaccaatgtctgcaccggtggcaagcaaatctactgtgacatctgtcagcaacactaactatgcaactcttcagaactgctcccttattactggtcaagacctattgtcagtccctatgactcaggctgcccttggggaaatagttcctacagctgaagatcaggtaggtcacccctccccagcagtacatcaggattttgtccaagaacatcgtttggttctgcaatcggtagctaacatgaaagagaatttcttatcaaattctgagagcaaagcaacaagtagcttaatgatgctggactctaaatccaagtatgtcttagatggcatggttgatactgtctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggac

SEQ ID NO: 19151 - DNA, 1573 bp, Homo sapiens
  ENST00000556952
atatagtatgcagcaaccggaggagtcacgttgggggaacggcagaaagcagctatccgtttacactactttgctctaacagctatcttaatgatcgcaagtgcggcggacatcaagcaagagaatgggatggaaagcgcctcggaagggcaggaggcgcaccgagaagtggcggggggcgcggcggtagggctgagccccccggctccagccccttttcccctggagccgggggacgccgcgaccgctgccgccagggtgagcggagaggaaggggcagtggcggcggcggcggccggagcggcggcggatcaggtacaactccactcggaacttctgggcaggcaccaccacgccgccgccgccgccgcgcagaccccgctggccttctcgcccgaccacgtcgcctgcgtgtgcgaggcactgcagcaggggggcaacctggaccgcctggcccggttcctgtggtccctgccccagagcgacctgctacgtggcaacgagagcctgctgaaggcgcgggcgctcgtggccttccaccagggcatctaccccgagctctacagcatcctcgagagccacagcttcgagtcggccaaccacccgctgctgcagcagctctggtacaaggcgcgctacaccgaggccgagcgagcccgcggccggccgctgggagccgtagacaagtaccggctgcgcaggaaattccccctgccccgcaccatctgggacggcgaggagacggtgtattgtttcaaggagaagtcgcgcaacgcgctcaaggagctctacaagcagaatcgctacccttcgcccgccgagaagcggcacctggccaagatcaccggcctctccctcacccaggtcagcaactggttcaagaaccgccggcagcgcgacaggaacccctccgagacccagtccaaaagtgagtcagatggcaaccccagcactgaagatgaatccagcaagggacatgaggatttatctcctcacccactctccagttcatctgatggcatcaccaacctcagcctttccagtcatatggagccagtatatatgcaacaaattggaaatgctaagatatcattaagctcttctggagttctgttgaatggaagcttggtacctgcaagtacttcacctgtcttccttaatggaaattcttttattcagggacccagtggagttatccttaatggattaaatgtgggaaatacacaggcagtggcattgaacccaccaaaaatgtcatcaaacattgtgagcaatggtatatccatgactgacatactggggtctacttcccaggacgtgaaggaattcaaagtcctccagagttctgctaactcagcaaccaccacgtcctacagccccagtgtccctgtctcattcccaggcctgatacccagcactgaggtgaaaagagaaggcattcaaacagtggcttcccaagatggagggtctgtagtgacttttactacaccagtgcaaattaaccagtatggcattgtccagatccccaattccggagcaaacagccagttccttaatgggagcattggattct

SEQ ID NO: 19152 - DNA, 3998 bp, Homo sapiens
  ENST00000345317
aggctctttcttctggggccgggaaaaccgaggaatacacatgcgcagttggacccctcaggcccttcgtgtcccttcccacccatctccccgccccggccctctgggcggggctgggccgacagtccagctgcagctcgctggagattcagtgacttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcaggatagtgtccatcacacctcaggggataagagcactgattatgctaatttttaccagggattgtgggattgtactggagctttttctgatgagttgtcatttaagcgtggtgatgtgatttacattcttagcaaggaatacaatagatatggctggtgggtaggagaaatgaagggagccattggcttggtgcctaaagcctacataatggagatgtatgatatttgagagtcctggaaaaggaaaattcttctgcttgtctgcaaatgctttggatttagaagcgtcatgaaagcacgagtgacagctcctaacctctccttgttttattaaacattacttatctttgactgttattttatgcagtcgctcattaaaatattcctctgatgtgaaattaaatgaaggatattaatgtaaattagatgcaaccagttaagttatacctgttgctattttgcaaagaaataattatagtttttatttacccatttgatttgtgtgaagaattcatcactattttatacgtaacatatagtctactatagcatagtatgctactattgctacttctggtgtgatttgtaatgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagataactttattgttattatttattttcacacatttaattcctattaagtacagccgcaagaaagaaaaaatgatgaagttgcaaatggcagtgtgctgtcacctgcaacagaagtgcgtaccagaagtatgactcatgcaaagcattttaccgtacaaatatcctggtgcgatgatgggcctggcaacattttctactgtacttttgtttaaatttaatgaaacaaaaaattcctaagaaataccaccctaccactaacaaaatggtataaagaatctcccagccaggccaacatggtgaaaccctgtctctactaaaaattagccaagtgtggtaatgttcacctgcagtcccagctacttgggaggccaaggcacgagaattgcttgaacaaggtaggcagaggttgcagtgagccaagatcgcgccactgcactccagcctgggcgacagagtgagactccatctcagaaaaaaaaaaaaaaaaaaacagaatctcagtgtattctcaaagtaaaaaggcataaccaagcactctcttatcttgccttattgctatactatttacatcccactgcagaacagcagatttgaggcttttctatatacttctcagagcactgaaaagaaaggaagggtttgcagaggagagtgtagaaatcccagtggtagcatgtaccaacaggtgagtagaaaggtagtgttagcctgacatttgagttatactctgtgctgcctgagcaagatttgtagaatcatataattaccttttcatgtatatttgaaatcagaggtgtttaaaatacctatgagataccaatgtagccttaacatatgtcaaaatgcattgctggttagataattatttggactacacataaactcctaatattgaatcattacctatcaggtattatctttatggaacttttcaatatctttgctttataaagattctaaacatgtatctgagctggtaatattttaaaatctccattatttgtgtaaaactgtttataagcagtgtttgagagggtctgctttaccattaccccctcaatatcatgatcatccaatctcaaatgtgaaaaaaaaaaagaaatttgattttagggattgtgagtaaacaagtttatatagagagacattgtgaagttaaagttttcagaagttacatttgtgcagttcttaccttttcctcatatagtgccattgaaatagactgaaattatcttggcaaaagttagacaaccaaagacgactttagtggactggttttcaaaacttgagcagctgaaaagcaaaagccgttgtttcccatgacaatgtagcctttgtggatttgggtttgtgctttgggttgaaaagaagtttttagtcctaggccagtagatggcagcagcttttcattgcagacaaaacctcttgaaacccttcccccatggcacaaactcgcccatgatggaaagcatctagatttctgcctccttttacagttaatccaggagagggagtcctttgccaactgatgaccaacagttccaagccagatagtctcgtgaacagtgacaatacagaaataaggtgttatttctgttcagatctccaccggcctttgttcttttaaaacttgaatataggtgggagacataagaaaggaaagaaaagacttaaaactggagtgacaggacaaataatcattactttcaattcatgactgctttatattcatttgatgaaatcatttgtatacaaaccagggagagttttctttacacccttgacaatatatcacatactcttcaagatcataataatatcattaatataaatttaaacaacatggcttgttagaaaatatgctaattgctatggtctcattatgtttgcttagcttttatttgtttttctgtgaacagttagagagctaatttttttcaaaggtgattgtaagtcatattttatatagcattttgcttgattatttgctctgtactgaatttgtactctattgccattagatcttacaataatgttccactctgcaaatttttaaggttcaaataaagtttaattgtttgcaaactgtta

SEQ ID NO: 19153 - DNA, 679 bp, Homo sapiens
  ENST00000489977
attgaacgctagtaaattctaatttcccttctccttttccttttcccccacttcctctcccctctcccttcttcccatctctctctgtctcctttttgaccagtaacattttagagttgaaagctatgctaaaggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcagtttacagcagcttctcccaaagatgctgaagaatgggtacagcagctgaaatttgtattgcaagatatggaatctgatattattcctgaggattatgatgagagaggagaattatatgatgatgttgatcatcctctaccaataagcaatccactaacaagcagtcaaccaatagatgatgaaatttatgaagaacttccagaagaagaagaggacagtgctccagtgaaagtggaagaacaaaggaagatgagtcag

SEQ ID NO: 19154 - DNA, 955 bp, Homo sapiens
  ENST00000468712
actgctccgcctgagaggaaccctggggtttaacgctgaagtgcgtttctcagagggcagagctggagcatctcgcagccctacaacttctttgcggcgcttggtctgtctttgcgttgcgagatcaggatcggtgtgttgctcagacaccggccgaacgccaccggcacgtctaggagtctcctgtgcctggaagaggctggtttcattcgattctaaaagaaacggatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtatatatcaggttgtagtttttatgttgccttgaaattaagttgataaaatgttttgatttcatttatagagacattaacatttgattaatactttccttgacatgttaacaataataaaaatactgatgtttaaatatattatgcattgaacattcatataagaggaaatttttaaaaatttcagattaattcacacactatcttcttg

SEQ ID NO: 19155 - DNA, 554 bp, Homo sapiens
  ENST00000495802
aatgatgccaaacatccaaatagtatttgctgtgatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggtgtgctctcagtaaaacggtattctattattatggaagtgataaagacaaacaacagaaaggtgaatttgcaatagatggctacagtgtcagaatgaataacactctaagaaaggatggaaagaaagattgctgttttgaaatctctgctcctgataaacgtat

SEQ ID NO: 19156 - DNA, 577 bp, Homo sapiens
  ENST00000432747
aatttttctctgcttgttggacatgaagagagggagacaaaggctctcagaaagagaaagacgggctggtgaaggacaaactaaggaatttgattattcacttttccaagataaagtggcatggagtggggaaagaccattaaggaatgctgaacataaaggaatcctggggacctgaccctcagttaagacataagaatgacaaccaggagtgtgctcgatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaagatcacagctttctgggatttgaatggcagaaacggtggt

SEQ ID NO: 19157 - DNA, 558 bp, Homo sapiens
  ENST00000490456
agttaaaccctttcccgcgggcgcagagtgggcctcccacgcttctctcccgtggccagtatgcgtgagagtgtgagttgagcccctgcctccgaggaagaattctaaaaaccgggctaagggtcgagcgagggaggctgaccttttcttgttatcaaattactgcgtttccctgaattacgggcactcaggaatggtgaaatctacatattaaccgaggaacacgaccctcaaaggaagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggagcccagtttcctccaattgcagcacaagaccttccttttgttctaaaggctggctaccttgaaaaacgcagaaaag

SEQ ID NO: 19158 - DNA, 585 bp, Homo sapiens
  ENST00000497511
ttccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatggttttaaaagaagaaattgagtccagagaggctcagtgacatgtttaaggtaaaaaaaaaaaaaaaaaaaggtatggaactgagatcacattacagacttctttaacctgtgccatggat

SEQ ID NO: 19159 - DNA, 513 bp, Homo sapiens
  ENST00000481204
agactggcttcgcccggacgactggcggaagacgagacttcgttacctccgttcaatcggacaaagaaggccataatagtttaggacaagagaaaattccttgtgggttaaactgcggtgggactgactgttacgcagaaggcgtaatcgcaaaacttgtatacactctgtatcatggatacattattttctggaatcctgcagaaacgatcagcagttgtgatggcaccagtaccgaaaatggctgtaaggcgctccggacgctggatcagatgttgaaacatttgtagcagatatactgaaaggagaaaatttatccaagaaagcaaaggaaaagagagaatcccttattaagaagataaaagatgtaaagtctatctatcttcaggaatttcaagacaaaggtgatgcagaagatggggaagaatatgatgacccttttgctgggcctccagacactatttcattagcctcagaacgatatgataaagacgatgaagccccctctgatgg

SEQ ID NO: 19160 - DNA, 536 bp, Homo sapiens
  ENST00000487720
ccttgttgtgagccccggcccggcagtgtcccgactcgtagccccgctgttcttaatccgggccgctagcctgagtctaggtcgcagccgcagccccaccccgtcggtcaccttttcagcgcaggtcctttccccgcacgccctgcgctccctaacatgcccaaccccagcagcacctcctctccctaccccctccctgaggaaattaggaacctgttggcagatgttgaaacatttgtagcagatatactgaaaggagaaaatttatccaagaaagcaaaggaaaagagagaatcccttattaagaagataaaagatgtaaagtctatctatcttcaggaatttcaagacaaagaaaaatatgctgctgtagtatgattaaaccttgagtttgttgcaatgtttgttactactgaaattataggaaggtgatgcagaagatggggaagaatatgatgacccttttgctgggcctccagacactatttcattagcctcagaacgatatgataaagacgatgaagccccctctgatg

SEQ ID NO: 19161 - DNA, 3332 bp, Homo sapiens
  ENST00000341418
atgatcccaaagagcctggtccaggcagcggaaacccagaggggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcggaagatttatggcgcctcccgggttccaaggacaggctgcgttcgtcgctgctgccaccgccgggacccccttcttctgactccgggcccggacccccctcctctcactcagggaaaaccgcgcagggacccaggaccctcaactgggccagaaagcaaagtgcaaggaccagcagcaacttgtgtgcctggagccttgcaatggctacgaagatggctgagattccttctagcccatatgagccgggacagcgaggcatgaaggatactcagagaggtgatgcccctcaaagaggaagcccagagccccgaatcctgcagttggcccgagtgggaaacgtatatctgaaggaggaaagctcaaggagtgggcgactggaagctaagaagtggatcccaacaaagttccttgagaacctctctgtcccacacgttgacctcggtggaaaccagctttggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggaccgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacgctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaataataataataataataataa

SEQ ID NO: 19162 - DNA, 3597 bp, Homo sapiens
  ENST00000554240
gcgccgtcacccggagagcccggcggatcccggactcccgcccgccgctcctcccgccgcgcacctccgctcaccgctcgcccggctccagccgccgccgcactgagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgttttt

SEQ ID NO: 19163 - DNA, 3620 bp, Homo sapiens
  ENST00000554054
gggcttcaggacccgggccggcagcaccggctgcgagggttgccgaaggcgcacggatctgggcgctgaaaaagccaggatttggcaatggctttgctgtgtggccttgggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaataataataataataa

SEQ ID NO: 19164 - DNA, 3675 bp, Homo sapiens
  ENST00000380035
gctgcgagggttgccgaaggcgcacggatctgggcgctgaaaaagccaggatttggcaatggctttgctgtgtggccttgggcaagtcactctgcgtatctgggtttcacttccttcccaatccgaaaacgggattgggttccttgcagcccgggcattcctgaggagcggcggcatggaggctctcaccactcagctggggccggggcgcgagggcagttcctcgcccaactccaagcaggagctgcagccgtactcgggctccagcgctctcaaacccaaccaggtgggcgagacgtcgctgtacggggtgcccattgtgtcgctggtcatcgacggccaggagcgcctatgcctggcgcagatctccaacaccctcctcaagaactacagctataatgagatccacaaccgccgcgtggccctgggcatcacgtgcgtgcagtgcacgccggtacagctggagattctgcgtcgggccggggccatgcccatctcgtcgcgccgctgcggcatgatcactaagcgagaggccgaacgcctgtgcaagtcgttcctgggcgagcacaaaccacccaagctgcccgagaacttcgccttcgatgtggtgcacgagtgcgcgtggggctcgcgtggtagcttcatccctgcgcgttacaacagctctcgtgccaagtgcatcaagtgcggctactgcagcatgtacttctcgcccaacaagttcatcttccactcgcaccgaacacccgacgccaagtacacgcagcccgatgccgccaacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgttcgcgcccgagagggatgagcacgtgaagagcgcggcggtggcgctggggcccgcggcctcctacgtctgcacccccgaggcccacgagccagataaggaagacaatcactcgcccgccgatgatttggaaacgaggaaatcctatccagaccaaaggagtatctcccagccaagtcctgcaaatacagacagaggcgaagatgggcttaccttggatgtcacaggaactcatttggtggagaaagatatcgagaacctggccagagaggaattgcaaaaactgctcctggaacaaatggagctccgcaagaagctggaacgggaatttcagagtctcaaagataattttcaggatcaaatgaagagggaattggcttatcgagaagaaatggtgcaacagctgcaaattgtcagagataccctgtgtaacgaactcgaccaggagcggaaggcgcgctatgccatccagcagaaattgaaagaagcccacgacgccctgcaccatttctcctgcaagatgctgacgccccgccactgcactggcaactgctccttcaagccaccgctgttgccctagggccggcctggccgcacccctgcgccctcaagccatgctgctccttgtaaatacccgctgctgcggtggccctgagcgaggaacaagccattcggacccgaccgatgtaaatacagccgcccgtccgcccgccttcctcccgggctccccggccttgcccgccccctcccgggcgtccctgtccagggccccggcttggtttccaagtgtaaataccgcctcgcgcctcaaatccccctaccccgtgtgaactctagggcatcggacctcaaggggttaactggacagacggggggcgggaggggagagcgccccctcccattgtatagccttgaacccgattgtgaatacaatgtagcaacttcgctggcgcctgccccgcactccccgtcccgtccacttctgaaactcctgttcctaatgacaaagtggctatgtgcaatggatataaatgtactgtgagtctctcggttcagtattaggttcactttaatttatttatgctgtaagttatttttgcttccttctcctggacccacttccagtcccgttttgcattcccctttggattttgctttggctattttttgttgtaacctcttgatgtaacagcactttaaaagggcgacaactgactcacgagatggcaaccacctggagcctgtttggggagaccaccctgtacccgtgactttcgtttttaataataataataataa

SEQ ID NO: 19165 - DNA, 3899 bp, Homo sapiens
  ENST00000425639
cgtacccacactttctgcggtggaggggacgccccgccgcaattcaggccgtcattctccccaggccggggtttgagcgccattcgctcgggccagagcccggatcttcgcgcggagcccgccagagtcccgcccgctggatacgaggacccgcttggatgcttcgcctccgagcgccctcggaagatgggccggcagccacacgcctaaagacacccagaggttaccagtgtccaaggcagacctgtagggctcggcccggggttctgcggcggagatggcttccagtccgctgccagggcccaacgacatcctgctggcgtcgccgtcgagcgccttccagcccgacacgctgagccagccgcggccagggcacgccaacctcaaacccaaccaggtgggccaggtgatcctctacggcattcccatcgtgtcgttggtgatcgacgggcaagagcgcctgtgcctggcgcagatctccaacactctgctcaagaacttcagctacaacgagatccacaaccgtcgcgtggcactgggcatcacgtgtgtgcagtgcacgccggtgcaactggagatcctgcggcgtgccggggccatgcccatctcatcgcgccgctgcggcatgatcaccaaacgcgaggccgagcgtctgtgcaagtcgttcctgggcgaaaacaggccgcccaagctgccagacaatttcgccttcgacgtgtcacacgagtgcgcctggggctgccgcggcagcttcattcccgcgcgctacaacagctcgcgcgccaagtgcatcaaatgcagctactgcaacatgtacttctcgcccaacaagttcattttccactcccaccgcacgcccgacgccaagtacactcagccagacgcagccaacttcaactcgtggcgccgtcatctcaagctcaccgacaagagtccccaggacgagctggtcttcgcctgggaggacgtcaaggccatgttcaacggcggcagccgcaagcgcgcactgccccagccgggcgcgcaccccgcctgccacccgctcagctctgtgaaggcggccgccgtggccgccgcggccgcggtggccggaggcgggggtctgctgggcccccacctgctgggtgcgcccccgccgccgccgccgccaccgccgcccttggcagagctggctggtgccccgcacgcccatcacaagcggccgcgcttcgacgacgacgacgactccttgcaggaggccgccgtagtggccgccgccagcctctcggccgcagccgccagcctctctgtggctgctgcttcgggcggcgcggggactggtgggggcggcgctgggggtggctgtgtggccggcgtgggcgtgggcgcgggcgcgggggcgggtgccggggcaggggccaaaggcccgcgcagctacccagtcatcccggtgcccagcaagggctcgttcgggggcgtcctgcagaagttcccgggctgcggcgggctcttcccgcacccctacaccttccctgccgcggccgccgccttcagcttgtgccataagaaagaggatgcgggtgccgccgctgaggccctggggggcgcgggcgcaggcggcgcgggcgcggcgcccaaggccggcttgtccggcctcttctggcccgcgggccgcaaggacgccttctatccgcccttctgcatgttctggccgccgcggacccctggcgggctcccggtgcccacctacctgcagcccccgcctcagccgccctcggcgctaggctgcgcgctaggcgaaagcccggccctgctgcgccaggccttcctggacctggctgagccaggcggtgctgctgggagcgccgaggccgcgcccccgccggggcagcccccgcaggtagtggccaacggcccgggctccggcccacctcctcctgccgggggcgccggctctcgcgacgcgctcttcgagtcgcccccgggcggcagcggcggggactgcagcgcgggctccacgccgcccgcggactctgtggcagctgccggggcaggggccgcggccgccgggtctggccccgcgggctcccgggttccggcgccccaccatccgcaccttctggaggggcgcaaagcgggcggtggcagctaccaccattccagcgccttccggccagtgggcggcaaggacgacgcggagagcctggccaagctgcacggggcgtcggcgggcgcgccccactcggcccagacgcatccccaccaccatcaccaccctcaccaccaccaccaccaccaccaccccccgcagccgccgtcgccgcttctgctgctgcccccgcagcccgacgagccgggttccgagcgccaccacccggccccgccgccgccgccgccgccgcccccgccgccccctctggcccagcacccgcaccaccgaggccttctgtctcccgggggaaccagctgctgctaccccagcgaggacagctccgaggacgaggacgacgaggaagaagagcaggaggtggacgtggagggccacaagccccccgagggcgaggaagaggaggaaggtcgagaccctgacgacgacgaggaagaggacgaggagacggaggtcctactcggcgaccccttagtcgggggcggccggttcctccagggccgagggccgtcggagaaggggagcagccgggaccgcgcgccggccgtcgcgggcgcgttcccgctcggcctgaactcctccaggctgctgcaggaagacgggaaactcggggaccccggctcggacctgcccccgcccccgccgccgcccctggccccccagaaggcgagtggcggcggcagcagcagcccgggcagcccagttcaccatccatcactggaggagcagccctcctacaaagatagtcagaaaactaaggaaaataaccaagtaattgtatctacaaaggatgacaacagcttttcagataagaacaaggagcatagctttttcatcacagactctgatgcttctggaggagatttttggagagaaagatcaggtgaacatacacaagaaaccaactcacctcattcactgaaaaaggatgtagaaaatatggggaaagaagaacttcagaaggttttatttgaacaaatagatttacggagacgactggaacaagaattccaggtgttaaaaggaaacacatctttcccagtattcaataattttcaggatcagatgaaaagggagctagcctaccgagaagaaatggtgcaacagttacaaattatcccctatgcagcaagtttgatcaggaaagaaaagcttggcgcccatctcagcaaaagctaaaaggtgcacagaactacttactcttgttctcttgtaagatacagcctgccatggagcacttctgacccgtgttaaagactgcagatcgaaagggcttgggaattaaatacaaaatcaggttcaggagaacctaaggacaagtgacctcaaaacagcatggacaaccatgtaaaatagactgtagcagccattcattagtggggggaggggggagccaaccagagcagtcaatgcttgttgcatcttttggtggaaccaaagttcgagtctttgtgtttttaaaggatagctgaacccagagcatgggaagtgctgttagccagttgggatgggaaatcagcggatggtcccaggcagtctcagtcctgcacacatggagaaagcaactctacaaaactgtcttctctttttgaagaagtgattcttggtggaagaaaacacaagacccatcctaggagtggggatagcgtttcaatggatgggaaggcaccagccgtacaaacctgcttttcatagcaaactggacagacttacatgtggccccttcctctctgtactttgcctgctgtatgaa

SEQ ID NO: 19166 - DNA, 891 bp, Homo sapiens
  ENST00000400404
atggcttccagtccgctgccagggcccaacgacatcctgctggcgtcgccgtcgagcgccttccagcccgacacgctgagccagccgcggccagggcacgccaacctcaaacccaaccaggtgggccaggtgatcctctacggcattcccatcgtgtcgttggtgatcgacgggcaagagcgcctgtgcctggcgcagatctccaacactctgctcaagaacttcagctacaacgagatccacaaccgtcgcgtggcactgggcatcacgtgtgtgcagtgcacgccggtgcaactggagatcctgcggcgtgccggggccatgcccatctcatcgcgccgctgcggcatgatcaccaaacgcgaggccgagcgtctgtgcaagtcgttcctgggcgaaaacaggccgcccaagctgccagacaatttcgccttcgacgtgtcacacgagtgcgcctggggctgccgcggcagcttcattcccgcgcgctacaacagctcgcgcgccaagtgcatcaaatgcagctactgcaacatgtacttctcgcccaacaagttcattttccactcccaccgcacgcccgacgccaagtacactcagccagacgcagccaacttcaactcgtggcgccgtcatctcaagctcaccgacaagagtccccaggacgagctggtcttcgcctgggaggacgtcaaggccatgttcaacggcggcagccgcaagcgcgcactgccccagccgggcgcgcaccccgcctgccacccgctcagctctataagaacaaggagcatagctttttcatcacagactctgatgcttctggaggagatttttggagagaaagatcaggaggattatatgcgaataaatgaggacaacatttggttatga

SEQ ID NO: 19167 - DNA, 3048 bp, Homo sapiens
  ENST00000620245
atggcttccagtccgctgccagggcccaacgacatcctgctggcgtcgccgtcgagcgccttccagcccgacacgctgagccagccgcggccagggcacgccaacctcaaacccaaccaggtgggccaggtgatcctctacggcattcccatcgtgtcgttggtgatcgacgggcaagagcgcctgtgcctggcgcagatctccaacactctgctcaagaacttcagctacaacgagatccacaaccgtcgcgtggcactgggcatcacgtgtgtgcagtgcacgccggtgcaactggagatcctgcggcgtgccggggccatgcccatctcatcgcgccgctgcggcatgatcaccaaacgcgaggccgagcgtctgtgcaagtcgttcctgggcgaaaacaggccgcccaagctgccagacaatttcgccttcgacgtgtcacacgagtgcgcctggggctgccgcggcagcttcattcccgcgcgctacaacagctcgcgcgccaagtgcatcaaatgcagctactgcaacatgtacttctcgcccaacaagttcattttccactcccaccgcacgcccgacgccaagtacactcagccagacgcagccaacttcaactcgtggcgccgtcatctcaagctcaccgacaagagtccccaggacgagctggtcttcgcctgggaggacgtcaaggccatgttcaacggcggcagccgcaagcgcgcactgccccagccgggcgcgcaccccgcctgccacccgctcagctctgtgaaggcggccgccgtggccgccgcggccgcggtggccggaggcgggggtctgctgggcccccacctgctgggtgcgcccccgccgccgccgccgccaccgccgcccttggcagagctggctggtgccccgcacgcccatcacaagcggccgcgcttcgacgacgacgacgactccttgcaggaggccgccgtagtggccgccgccagcctctcggccgcagccgccagcctctctgtggctgctgcttcgggcggcgcggggactggtgggggcggcgctgggggtggctgtgtggccggcgtgggcgtgggcgcgggcgcgggggcgggtgccggggcaggggccaaaggcccgcgcagctacccagtcatcccggtgcccagcaagggctcgttcgggggcgtcctgcagaagttcccgggctgcggcgggctcttcccgcacccctacaccttccctgccgcggccgccgccttcagcttgtgccataagaaagaggatgcgggtgccgccgctgaggccctggggggcgcgggcgcaggcggcgcgggcgcggcgcccaaggccggcttgtccggcctcttctggcccgcgggccgcaaggacgccttctatccgcccttctgcatgttctggccgccgcggacccctggcgggctcccggtgcccacctacctgcagcccccgcctcagccgccctcggcgctaggctgcgcgctaggcgaaagcccggccctgctgcgccaggccttcctggacctggctgagccaggcggtgctgctgggagcgccgaggccgcgcccccgccggggcagcccccgcaggtagtggccaacggcccgggctccggcccacctcctcctgccgggggcgccggctctcgcgacgcgctcttcgagtcgcccccgggcggcagcggcggggactgcagcgcgggctccacgccgcccgcggactctgtggcagctgccggggcaggggccgcggccgccgggtctggccccgcgggctcccgggttccggcgccccaccatccgcaccttctggaggggcgcaaagcgggcggtggcagctaccaccattccagcgccttccggccagtgggcggcaaggacgacgcggagagcctggccaagctgcacggggcgtcggcgggcgcgccccactcggcccagacgcatccccaccaccatcaccaccctcaccaccaccaccaccaccaccaccccccgcagccgccgtcgccgcttctgctgctgcccccgcagcccgacgagccgggttccgagcgccaccacccggccccgccgccgccgccgccgccgcccccgccgccccctctggcccagcacccgcaccaccgaggccttctgtctcccgggggaaccagctgctgctaccccagcgaggacagctccgaggacgaggacgacgaggaagaagagcaggaggtggacgtggagggccacaagccccccgagggcgaggaagaggaggaaggtcgagaccctgacgacgacgaggaagaggacgaggagacggaggtcctactcggcgaccccttagtcgggggcggccggttcctccagggccgagggccgtcggagaaggggagcagccgggaccgcgcgccggccgtcgcgggcgcgttcccgctcggcctgaactcctccaggctgctgcaggaagacgggaaactcggggaccccggctcggacctgcccccgcccccgccgccgcccctggccccccagaaggcgagtggcggcggcagcagcagcccgggcagcccagttcaccatccatcactggaggagcagccctcctacaaagatagtcagaaaactaaggaaaataaccaagtaattgtatctacaaaggatgacaacagcttttcagataagaacaaggagcatagctttttcatcacagactctgatgcttctggaggagatttttggagagaaagatcaggtgaacatacacaagaaaccaactcacctcattcactgaaaaaggatgtagaaaatatggggaaagaagaacttcagaaggttttatttgaacaaatagatttacggagacgactggaacaagaattccaggtgttaaaaggaaacacatctttcccagtattcaataattttcaggatcagatgaaaagggagctagcctaccgagaagaaatggtgcaacagttacaaattatcccctatgcagcaagtttgatcaggaaagaaaagcttggcgcccatctcagcaaaagctaa

SEQ ID NO: 19168 - DNA, 6885 bp, Homo sapiens
  ENST00000262461
acactcgcgcgctcgctcggctgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacctatttaatgtcca

SEQ ID NO: 19169 - DNA, 4263 bp, Homo sapiens
  ENST00000509205
ggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagttttatgaaccatgctaaattcttatttccacatggtctaggaatgactgtcctgtttcatttcagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaa

SEQ ID NO: 19170 - DNA, 5509 bp, Homo sapiens
  ENST00000343225
tctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatccttttttttttttttttttttttttgagacggagtcttgctctgttgccacgctggaatgcagtaacgtgatcttggctcactgcgacctccacctccccagttcaagcgattctcctgcctcagcctccctagtagctgggactacgggtgca

SEQ ID NO: 19171 - DNA, 3653 bp, Homo sapiens
  ENST00000504416
cttaaaatcttgttgccagaaacacaaatttatctaattttgtttgtcttttcatcttaaattaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcagtaagtatctttttaattcaataatttagttcatttagaaaatgttaattttgaaagcttgtcctaatttttggagactgtttctcatatagtctcttgtaatggaaatataagaacgaaaagaatcacacaaagcatctgggttttaaattgataatctattaacaattttttattgatctttatatgtctctttacatacatgcatatatatatatatacacacacacacacatatatgtatgtatatgtatatatgtatacactctggcttctcatttaagtttgtaaactttttcctatccctccagctgttgctgagcagagttcccaaatgtcagacccatcacctcctaaactatgtcattataatgtgctgaggaagagtgttttatcgctgtttaggcttgttccccttccaaacaaattttgcagttaatcatttggttcattcattaagttatttacatttcttttatttaaatgtacttatatgttttgtttttctaccactatgaagagttaagtttgagttcactgtaacttccgttttttgcgttgtctagtgcagcagtccccaacctttttggcaccagggaccagtttcatggaagacaatttttccacagacatgggtagtggtggggtctgtggtttcaggatgattcaagcgcattacatttattgtggactttatttatattattattacatattcaccgtaatgtagactcagtgggagtcctgagcttgtttttctccaactaggcagtcccgtctgggggtgatgggagacaattgacgatcatcaggcattaaattctcataaggagcgcacaacctagattcctcacatgcgcagttcataataaagtttgcactcctttgagcaattggtgccgctgctgatctgatgaggtgtacttcaggtggtaatgctcacctgcccatggctcaccttctgctgtgcagcccacccagttcctaacaagcctggctcattactggtccatgacccaggtattggggacccttggtatagtgcgttcttttttattctttgctactttgtctttctggttgtgttctgtttgtggattttgtggatgtttaatgtaatctaccacatactttttgtttaataacaataaaactttttttttgtttttgccagattttcttcttaatcttgaaaagtacttcttttcctactattctaagatttgcctaacctatttatcttgtttatactgaagataagcattccctctccactatgccatacttgatttgaggagtagtttttttctcatcctaagcactgatgaaatagaactgtctgcttcctcttataattgtcctttaaaaaaaacttttatttacaaagtagctttaagattaaagtttaagtcctattttctccatgaattttgatctgatcacccttttttctcactggagttacttccttactggaactcctgttgtatctttggctataaccacatatatttgcctgtctcacatatgatggttttattagtgacatttgaaaagtctttgaggaagcagctggatctcatactctactttttaaaggatctctttatatggattagtaatatatatgataaacaagatttaccaactaatcgttaaatgcttttagtaaaattaaaactgctgatgtgttgtatgttgttactactgctgagttttggttttattaatgtttttgtaagcaaaacctcattgtggctttctaattttgtattctgtgtatatagggattagggacagaaagattaatgtggtccatgagccatgaaaccctatgctttttccctctcaagacctaagaacagtgagatgacgtaattatcctaaaaaatagaaaaagtgacattttttacaaattctttcatacacctgtcacattattagttgtagttgctcataatggaacactggaaggggtctttctgactctgactttctagggattaaagtgagtgagtgttctgaaagttgagtattagtctaaacattattcctgtacattaggcagcagttaaagaataggtaaaatactgctttctggttttagaaccatgtaaattaatagcagtttcacagcagtgacactgctcattctttatcttgttgcacttccactgatgttttagctgtgatttttaaataccttgtgcaatttaagtatgctttatatattgtgtttttattaatagtatataagatctgaagctgcaaatcaatttttatagcttataacaaaaacatttatttgttttaatccacagtaaacttggggagctatattccctggctttaaagaaattgattttgatttagtcgatttattaaacaatttttaaaatgcttatagttattttttctctagtattaattatatctttcaagatacagctgagaaagattaacatgcctattaaatttatttctccagtgactttgttaactttagctcatcataggaatgtggccaaattgtctctccatgatttaaaaacaacaaaagaccttttataaccatatattatatcctgaacacattcttccatttgtcagtaagagtaataatttgactgttttattggattttagcctttttgatttcatatagctgtatcttaatatatcattgtttttaatatgtctacattgaatacttattacttgtgcaatgaaaaataataattaaagatgaaagttaagcctgttaccactttcagagaacaacgtgacgttttggaatttaaaattttttcagtagatttgagaaaaacttgggttaaaatgaagatttatgctcagaactgagattccagggtttaagtctggttttaaagctgtcttcaagattttaatgtattttctgtgtgtataggatgctctcatttctgtttttaaaaatgaaagggatcgctcctgtaatcccagcactttgggaagacaaggcaggtgggtcacgaggtcaggagttcaagaccagcctggccaatgtggtgaaaccctgtctctactaaaaatacaaaaattagccaggcgtgctggtgtgtgtctgtactcccagctactcgggaggctgaggcaggaggattgcttgaaaccgggaggcagaggttgtagtgagccaagattgcgccactgcactccagcctgggcaacagagcgagactctgtctc

SEQ ID NO: 19172 - DNA, 580 bp, Homo sapiens
  ENST00000509616
ttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaaggtaaattttgttggcaataagttttttatttacaaaaatataaactactttgttagaaaattatattctcacaaactgggctcttcgttacttttaataattatgtatcgtggacttattgtatggcattttaaga

SEQ ID NO: 19173 - DNA, 555 bp, Homo sapiens
  ENST00000507791
tcaaaaattacaatatttctcacagtcgtgctgcgtttgggagatacacagtcatgtcaacatacatgaattttatgagaaggagatagagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaaggtattc

SEQ ID NO: 19174 - DNA, 489 bp, Homo sapiens
  ENST00000502849
tagccatttataaagtatacttttattataaacaactgaaagtttatggtagatgccgtatacaattgtctgaattatctgtagtataaacatctgaatatacaaacattaggaaatgataggaattcagcaaaagggactttaatatttactttgcttacattttatattttgcttaatcctttagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaat

SEQ ID NO: 19175 - DNA, 3617 bp, Homo sapiens
  ENST00000628403
ggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagttttatgaaccatgctaa

SEQ ID NO: 19176 - DNA, 3119 bp, Homo sapiens
  ENST00000566786
ctggcccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagaggtgccaggccatcagtctctggcgctttggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaa

SEQ ID NO: 19177 - DNA, 5567 bp, Homo sapiens
  ENST00000438926
ctggcccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaagcaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagaggtgccaggccatcagtctctggcgctttggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaggcatggccacctttctgttgtgccttgcatttgtccacacacagggagtctggctgagctggggaaaggccacggctgggtgtcattgccattttcccagctcatctcaccgggaagaaaagcagattgacagaacacgtgaggaggggtattgatggcaggagagtcaaaaaagagttttaaagaaggggcaaggttgaaggagtctagtggcaagggtaagatttcaggcatggttaagaacagacgacaaggatgtcaggaatgaagatgtggagaggggtgtagagatggcaaggttggcaaggaacagataggcaggagcaggtccaagccaagcctagcccaagaccaggtgaaaggagaggggaggaggagccacctgcaagagatggaaagagcaggcggcagagggggctggcagggaggggctgttaagagtggggttggaggtgggagagaagctaggacaagggagatggagaaaggacctatacctggctcacggaaggccttcaggtcactacacgttgaacatccccagtgtttgagcccccaaagctagggtgcaagagcactgccatcgaatgccagtgggtgaggccaagtgagggtatttgcagctctagacataaccaagaagcgtaaaggtgagttgtttggtggtacgactgcctgtgccttcttccgatggcactggggtggctgaaggaacagacatctttgggtttcatcagcctcctccaagactgctgcagtgcctacactttagacttcagaaggagactaaagacttctagaatttagaaggagatctgaagtctcctttctggagttacaacccaaaggatgttagcatttctcaggtcatcccactgcaaagcccagaaggcttggggctcccaggctgctctgaagccccactgtctgaccgcctcagggcttgctacgagggactggggcacggccaagctgactaggaacagctctcgtgctcctgagggacctggaggatgggcctgcctcccagccattgagctggattctgggataattcttaactcgaaataaggggaagcatccatcagggaatgctggcctttctagagccacgtagaaaacaattttctggttcttcaaacctcaaagagtccttggtccaaaaaacagaatgttttggcttcgggtgtcaaaaaaaaaattttcacgatgtcagaaatagtatgtttttaacaatagtaatagctttgtaaaaaaataaaaagctttaacagcgaggccataaacaatgaaatgaataaaaacggtggtcattcagtcaacggaa

SEQ ID NO: 19178 - DNA, 4208 bp, Homo sapiens
  ENST00000563236
cccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaagcaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagagtggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaa

SEQ ID NO: 19179 - DNA, 4208 bp, Homo sapiens
  ENST00000262502
cccctccctggacacccaggcgacaatggcagaactgcccacaacagagacgcctggggacgccactttgtgcagcgggcgcttcaccatcagcacactgctgagcagtgatgagccctctccaccagctgcctatgacagcagccaccccagccacctgacccacagcagcaccttctgcatgcgcacctttggctacaacacgatcgatgtggtgcccacatatgagcactatgccaacagcacccagcctggtgagccccggaaggtccggcccacactggctgacctgcactccttcctcaaggaaggcagacacctgcatgccctggcctttgacagccggcccagccacgagatgactgatgggctggtggagggcgaggcaggcaccagcagcgagaagaaccccgaggagccagtgcgcttcggctgggtcaagggggtgatgattcgttgcatgctcaacatttggggcgtgatcctctacctgcggctgccctggattacggcccaggcaggcatcgtcctgacctggatcatcatcctgctgtcggtcacggtgacctccatcacaggcctctccatctcagccatctccaccaatggcaaggtcaagtcaggtggcacctacttcctcatctcccggagtctgggcccagagcttgggggctccatcggcctcattttcgctttcgccaatgccgtgggtgtggccatgcacacggtgggctttgcagagaccgtgcgggacctgctccaggagtatggggcacccatcgtggaccccattaacgacatccgcatcattgccgtggtctcggtcactgtgctgctggccatctccctggctggcatggagtgggagtccaaggcccaggtgctgttcttccttgtcatcatggtctcctttgccaactatttagtggggacgctgatccccccatctgaggacaaggcctccaaaggcttcttcagctaccgggcggacatttttgtccagaacttggtgcctgactggcggggtccagatggcaccttcttcggaatgttctccatcttcttcccctcggccacaggcatcctggcaggggccaacatatctggtgacctcaaggaccctgctatagccatccccaaggggaccctcatggccattttctggacgaccatttcctacctggccatctcagccaccattggctcctgcgtggtgcgtgatgcctctggggtcctgaatgacacagtgacccctggctggggtgcctgcgaggggctggcctgcagctatggctggaacttcaccgagtgcacccagcagcacagctgccactacggcctcatcaactattaccagaccatgagcatggtgtcaggcttcgcgcccctgatcacggctggcatcttcggggccaccctctcctctgccctggcctgccttgtctctgctgccaaagtcttccagtgcctttgcgaggaccagctgtacccactgatcggcttcttcggcaaaggctatggcaagaacaaggagcccgtgcgtggctacctgctggcctacgccatcgctgtggccttcatcatcatcgctgagctcaacaccatagcccccatcatttccaacttcttcctctgctcctatgccctcatcaacttcagctgcttccacgcctccatcaccaactcgcctgggtggagaccttcattccaatactacaacaagtgggcggcgctgtttggggctatcatctccgtggtcatcatgttcctcctcacctggtgggcggccctcatcgccattggcgtggtgctcttcctcctgctctatgtcatctacaagaagccagaggtaaattggggctcctcggtacaggctggctcctacaacctggccctcagctactcggtgggcctcaatgaggtggaagaccacatcaagaactaccgcccccagtgcctggtgctcacggggccccccaacttccgcccggccctggtggactttgtgggcaccttcacccggaacctcagcctgatgatctgtggccacgtgctcatcggaccccacaagcagaggatgcctgagctccagctcatcgccaacgggcacaccaagtggctgaacaagaggaagatcaaggccttctactcggatgtcattgccgaggacctccgcagaggcgtccagatcctcatgcaggccgcaggtctcgggagaatgaagcccaacattctggtggttgggttcaagaagaactggcagtcggctcacccggccacagtggaagactacattggcatcctccatgatgcctttgatttcaactatggcgtgtgtgtcatgaggatgcgggagggactcaacgtgtccaagatgatgcaggcgcacattaaccccgtgtttgacccagcggaggacgggaaggaagccagcgccagagtggaccccaaggccctggtgaaggaggagcaggccaccaccatcttccagtcggagcagggcaagaagaccatagacatctactggctctttgacgatggaggcctcaccctcctcattccctatctccttggccgcaagaggaggtggagcaaatgcaagatccgtgtgttcgtaggcggccagattaacaggatggaccaggagagaaaggcgatcatttctctgctgagcaagttccgactgggattccatgaagtccacatcctccctgacatcaaccagaaccctcgggctgagcacaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgatctcaggtcactgcaacctcctcccgggttcaagcatttcttctgtctcagcctcccgaatagctgggattacaggcacctgccatcacacgagctaatttttgtatttttagtagagatggggtttcaccatgttgaccaggctggtgttgagctcctgacctcaggtgatccacccacctcggtctcccaaagtgctggggttacaggcctgagccactgcgcccggcccaggcaaatttcttgaaccacttctcactcccgtcactttcaataaggggtctttgatgtcttcactggttctttggacgagggacttttcgaacttttttggttgcaacacacagtaagaaatatacttcacactgagacttgcagcgcacacacacggaaacgaccaaaacaaaaatgtcacaaaacaatacttacccttccctgggggacgtcctccagtatgttctgttctgtttatttttcactgttggttgcaatccaataaaatgactttgggatccactcatgggtggggacccacacatttgaaaggc

SEQ ID NO: 19180 - DNA, 745 bp, Homo sapiens
  ENST00000569002
catggaagccactttgtaaatggcagtgtccgatgggtttcagcctgaaaatgggagctgtggcaacactgccagctccccgcagggacctggcacccctagaaatggggttatcgtctcagccggcctcaacccactttctcgtccccagcaccaagaggtttgaggacatgattgcacccttccgtctgaatgatggcttcaaggatgaggccactgtcaacgagatgcggcgggactgcccctggaagatctcagatgaggagattacgaagaacagagtcaagtcccttcggcaggtgaggctgaatgagattgtgctggattactcccgagacgctgctctcatcgtcatgtaagtagtgcccggctggtgggaggaccagtctgtccagagtcaggtgtctcagctctgggaaggggctcagcaggggcaccacggagggcccaagccttcccctaggaagcagaagggccaaagttcccataaacatagccctggcgattcttagcatgtggctgggcctgagcccgccccacacctgagctccagctggcaggggtcgagggcctcacgtgtcccaggcatcagtgacctccccttgccattgctttttcctgttggctgccttttcctaccaaattccacttggcaaagagggaacccagctctttcaagagggacatcaactcctggttgttcaggaattacttggccctccttggctatcggccattcccagct

SEQ ID NO: 19181 - DNA, 787 bp, Homo sapiens
  ENST00000563352
cacatgaaaaaaagatgcccaggagaattcaaaaggcaccagcaccagttactcttcattgacaggacagagcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaactccaggctttgacatccctgtccacagctctgagtgtgtgggataagttggaacttgattgcctctagtccacagggatgagactcatgttctgttgcactttaagtggcagcatctgatgatctcaccgaaaaagatggtagatttccaaatctggctggactccacttccatgggacacattccctgggtcttgtgtttataggctagagaaatagcagatggagctgcaaggaaaactctctaaagcatcctattccttttaaaggatttcttttgattttgatgaccattaattaagagttcagtctttgatttgtatgcaaattggagtcccaatgctgggcgtgaatcttgacagtttctacagaccttcctgggtgaaagttcctaaatcatgccctgcttcctccaataggagaatgggagcctcacctgtaggacctacaggctctctaaggaatgcaggtctctctctgagcctccacagccaggcaaatacatatatatatattttttttttagatgaagttttttctcttgttgcccaggctagggtgtaatggcatgat

SEQ ID NO: 19182 - DNA, 4765 bp, Homo sapiens
  ENST00000316341
cccggggggcgggcggaggaagtgagcgcagcggggaggaatgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactggg

SEQ ID NO: 19183 - DNA, 3620 bp, Homo sapiens
  ENST00000572037
acggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactat

SEQ ID NO: 19184 - DNA, 3627 bp, Homo sapiens
  ENST00000541864
gagtcctgctagatccccgcaagctaggccagctcctcccactgcctcccttcctctttctcctcctcttactcctttccagccagaccttggctgtctacaggatgggggacaccctgagccccggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacg

SEQ ID NO: 19185 - DNA, 3768 bp, Homo sapiens
  ENST00000576616
atgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactgtatccctttgtggagaggcaggcagttgggaggtggatagcatgggaggtcaagccagcggcttctctcctgggcacccctgggtgggcatggcccaggtggcccgggttgcccgttgattctgttgttgcctccttgacttgaggccctgcagacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagag

SEQ ID NO: 19186 - DNA, 3761 bp, Homo sapiens
  ENST00000570802
atgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccgtgagtgcagcaaaaacagccccagcggcactggaatctaggggtggaggtggggtggggcagacaagtagtgttagatgggccaggggtggggaccctccttgcaggatggctcatggcgacctgtgactggctacactacgtgtagggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagag

SEQ ID NO: 19187 - DNA, 3525 bp, Homo sapiens
  ENST00000537830
agtgcatggtggggtagccagccggccacctttgggccatggcagccgaaggtgctgtgtgcggcttcgtctatctggagggcactgcctgggcggtccctgaggacaccgaacccttggcatcctgcacattgggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcct

SEQ ID NO: 19188 - DNA, 406 bp, Homo sapiens
  ENST00000570616
cccctgacaatttccgggagctggtgcacattaagccgatggctcatggcgacctgtgactggctacactacgtgtagggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctg

SEQ ID NO: 19189 - DNA, 588 bp, Homo sapiens
  ENST00000575857
gccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctg

SEQ ID NO: 19190 - DNA, 3649 bp, Homo sapiens
  ENST00000573023
atgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggtagctgaggagccattttgggccacaggtttggcacacagaggctttagctaagcaggcaggctggacacgtgggcctcctctgtcttgctcttcctctcatctcctcttgtgttcctggttctcatggcagccgggctgcagttcccttggccctttcaactgaaactgcctttccagaggccactcacaatcccacccccattgctacctccagggtggttcacctctgacttccttacaacccctcagcaaggaaacgcccgcttaggatttcccaactcaggatttctcctcttccttccactcctggttcttctccaagtccatggttcttcgctctcccatggattcttccttgtctttcttggttgacccttccagctctgtccctctctagttccctgagtcctggtccatttgcagctttaggggatacgtctctggaaagattcccaaatatctgcctctgtacttgagttttatcttcttcagactcaagctgagcagtgagatctggatttaagacgtagtttaagctcctaaactctgacccatgcattcagccactgcatggctgagtaatggagactccttaatctgccttttttttctctttcttcattttgagatggagtctcactctgtcgccccaggctggagtgcagtgacgcgatctcagctcattgcaacctctgccttccaagctcagcgattctcctgcctcagcctcccgagtagctgggattacaggtgcccaccacatgcctggctaatttttgtgtttttagagacggggtttcaccgtgttggccaggctggtcttgaactcctgacttctagtgatcctcctgctcagcctctcaaagtgctggaattactgctgtgagccaccacatctggccgaggctccttaatctccacatgcccccaagggccctcgtcttcctttctcacaccaaagcaacttctccctgtgtgtaggtcagaaaggagctgacagagagggaaaagctaaatgtgggcaggaggcaggtagaagcacagcctcgagaaggctgcaggagcagggatcatcgcctagaccccggtggggctgggggacctgagctctgggaggcctcctgacctgggaaagcagcaaggttctgcggtgaaggccttggcccagccccgcctgaggatgggctggaggatcaggatcccatctccgcgattgatgaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtgtatcctttcccaggcctggggcaggtggggcagaggacgggaagcgcttggcctgtgtacgttgccaggtcacatgcacagacaccccacacactcatatatagctccccttctcatgcacacatgcacatacacaccacgagactcccagctgtaggtgtcctggtagtctggctggggtgggggcacgtggtactattcagggacagtggggtggcagaggccgagttttccttgacgccgccgcagacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgc

SEQ ID NO: 19191 - DNA, 412 bp, Homo sapiens
  ENST00000576513
gtttagggctcatccaaaggagagaggcctggtgaggtggaatcagggagactggtgacacccatagggatagacacaggggcggcctgagcccccaaggcgggccctgggggtgagggaggccaggctggggtctggggcccaaggtgtggaatgggggtgacaggacccagcttccttcctggtgcacacaggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactg

SEQ ID NO: 19192 - DNA, 573 bp, Homo sapiens
  ENST00000572476
cggctccttcttttcaacgtgtggcgctggcctccagagcctcacaggggcaccacgcctattgcaggccattgccaaggacaacatcatccccttcctccgggtgagcccctctgcactcccccatggcctggctgctcccaggccctcgcccggctggggagagagatagggaacacagatgcagcacgtcctgcccttattggcccccggggccaggcggccatccatgaggagctactgagaagtgccctgggcctggcactcacctgggcctggagctgcctggacccagaatcttcatggcctgtttagggctcatccaaaggagagaggcctggtgaggtggaatcagggagactgggcagggggatggggaaaggcttcctgaaccccagcacctccccgtggctgcgtctggtgttggaggtccagctgggagatgtggcaggctgcatggggagatgtggcctgacagggctcagcccacccctgcatttaggagcaagcctggcacctatgccaaagctataaggtgaccaatatgtccacacctccctgaggcccccagag

SEQ ID NO: 19193 - DNA, 847 bp, Homo sapiens
  ENST00000574665
agtggcgggctctgggtgacggtggttcagccacctttgtctgtcgacttctagctgggcagctccttctctgtggtcagggtagccctgtggctgacgctgcagtcattgggctgaagctgttccctgagtccccaaagttgccctgcatctgcgcctctggctaggctgccccaaactacctggggtagtggggggcagctgtggtggtgacacagctacccctgcagaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatg

SEQ ID NO: 19194 - DNA, 515 bp, Homo sapiens
  ENST00000572766
tctctgtggtcagggtagccctgtggctgacgctgcagtcattgggctgaagctgttccctgagtccccaaagttgccctgcatctgcgcctctggctaggctgccccaaactacctggggtagtggggggcagctgtggtggtgacacagctacccctgcagaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccac

SEQ ID NO: 19195 - DNA, 633 bp, Homo sapiens
  ENST00000573702
ctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggtgagccctgcctgcctacccacccagccctgtccccaatcccggggagcccctgagggagtctcatctgtttttggaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcac

SEQ ID NO: 19196 - DNA, 868 bp, Homo sapiens
  ENST00000576377
gacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggacc

SEQ ID NO: 19197 - DNA, 891 bp, Homo sapiens
  ENST00000571299
gtcttgcggggcccagcggctctgattccgtaccccccaccccaagggctggaggctggcagtaggcgtagtcagaggacgccacccgagccacgcgagggagaagagtggagatagacaagacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggc

SEQ ID NO: 19198 - DNA, 1016 bp, Homo sapiens
  ENST00000572010
gaatccccagctgcctccaacaggagaggctgcagctagagggcccagggctgggacgggaccttcgcgggggtctggttcccagggtcgcggagaaatgggatgcagacgctggaaatgggaaggaggacatggcaaccacagagagagcagcccttttctttcccccttggaggcttccagaggaattgactactatgacaggaacctggcactgtttgaggtagctgaggagccattttgggccacaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgggtaagcagccacagaaccctgctggaggtcggcgctccctccacgagccccatgggagctctgtcagcctcagcttctcattccccagtgaactgccgtaccagtgggagaagagacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatct

SEQ ID NO: 19199 - DNA, 673 bp, Homo sapiens
  ENST00000576462
ggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccaggtcagtgagcgccacccaaggcctggtggaagagaaaaggacccagtatctgccttgacctacctgggaacccccatagcacacccctgccccaagcagttctgtagtgggctcccaatccctgatgccaggacagtgcccacgtaggagctttcctgcttgacagagttggagagtgccattgtggtttttgttaatataaaagcaatacca

SEQ ID NO: 19200 - DNA, 4670 bp, Homo sapiens
  ENST00000422611
cccggggggcgggcggaggaagtgagcgcagcggggaggaatgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactggg

SEQ ID NO: 19201 - DNA, 3593 bp, Homo sapiens
  ENST00000454036
ctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaaggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccc

SEQ ID NO: 19202 - DNA, 401 bp, Homo sapiens
  ENST00000628272
agagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaa

SEQ ID NO: 19203 - DNA, 617 bp, Homo sapiens
  ENST00000626701
agccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaagtctcccctcagggggcactcatcaggggtcctctccctggctctgaggccctcgggtctggaaggaacaaggcgaatcggcttgtagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaa

SEQ ID NO: 19204 - DNA, 248 bp, Homo sapiens
  ENST00000428198
ggttcacggtcacctcgctgccccccgcagggcccgccagaagccctgacccagagtcccgccggcattcggtcgcagacccccgccacctcccgggggaagacgtcaaaggagctaataatcagaggctgctgaggggcatggatatgactgcatccttgtctcttctatggaggcaagacgacttttataagttctatcaatgaagagagtcctaaactggagtaaagcaaactggatgctagacc

SEQ ID NO: 19205 - DNA, 411 bp, Homo sapiens
  ENST00000413737
ggcattcggtcgcagacccccgccacctcccgggggaagacgtcaaagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcagcaaatccaactgatccccacgtcttggccattcacctctgaaacttatcctgaatctggcagcatcggtcccccctctgtcatcatcgccctgctccaagcctcacatggccacgaccacatcctctccactggcctccctgcctccagtccttccctagccctcctccacagaagccccccatcacttgcaaaataaaggccaaagccttaagtctgtca

SEQ ID NO: 19206 - DNA, 391 bp, Homo sapiens
  ENST00000626695
ggttgggggcgtcttcctcgcgggccctgtgcagggtcttgtaatggaagttacacgcagggcacagagtataggggaggggaaagatccttctggccttcggtggagaagtagcatcctgggcgcgtgcacagtctcccctcagggggcactcatcaggggtcctctccctggctctgaggccctcgggtctggaaggaacaaggcgaatcggcttgtagtggccccagcgaggggaggaggaggaggaggaggaggaggaggaggaagaggaggaggaggaagaggaggaggaagaggaggaggaggagaaggaggaggagaagcctccccagaccgccaggggtcgctgccgagccgcagcaaatccaactgatccccacgtcttggc

SEQ ID NO: 19207 - DNA, 571 bp, Homo sapiens
  ENST00000608944
agtttttgtgcaagggggccactagtcgggctctgcccgcccctcatcttctcttctctctccctcccgctctccccccaaaaccccgccagtggctcacgcctcctgcatacgggatgaggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatga

SEQ ID NO: 19208 - DNA, 1455 bp, Homo sapiens
  ENST00000622711
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgtgagtgctgctgctctgagcccaaggaatcgtcctcctacctccctggccctgtttcagagtctctgccaaactccccctccctgcccctcagaatctcagagtggtgtgggttgggagtagcttcccttgggagggaaaatctctcttagtttgggggcaatctcttcagagtgaggtaacttttctggaggagggaacaatttaccttgtaagagtcaacttcttgctggtagggtggacttaggaagaattaagtgggaatgagttccaaagcaatgaatgctgtctgtggtagggaaacctttcctgggtggggacaacctcctggaatgggacaatctcctagtgttggacaactcctccaggatgggaaaagacacagaagtctacagggtccagggactcagatccaagtccactccatccactgctcagaggtggagggcggcccccgagaccgctgtccacggtgctgaaacacagcattgcactaatgcggtgcttctccaccttggctgcttattagaatcacttggggagcttaagaaaaaaaaaaaaaagccaat

SEQ ID NO: 19209 - DNA, 1947 bp, Homo sapiens
  ENST00000629054
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggtgggctgctagggctgttgggcccccacctacaattcattatcctgattcatcagctgctctctccctccctccctagggagcaataccctcgtctccacccctcccttgagtctaccttcttccttgagcctccccatccctccttctccctcctgggatttactccctctgctccctgccctctcctcatcctaccattcttacccctgttctcctcacctgttcctcctcctttcccatctcatcccaacctgaatagtttcgtgctccttgtccccatctcttcctctgcccttcgccacccagctcactccacttgctcccccagcctcctagcactgacaccctccctccataggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgtgagtgctgctgctctgagcccaaggaatcgtcctcctacctccctggccctgtttcagagtctctgccaaactccccctccctgcccctcagaatctcagagtggtgtgggttgggagtagcttcccttgggagggaaaatctctcttagtttgggggcaatctcttcagagtgaggtaacttttctggaggagggaacaatttaccttgtaagagtcaacttcttgctggtagggtggacttaggaagaattaagtgggaatgagttccaaagcaatgaatgctgtctgtggtagggaaacctttcctgggtggggacaacctcctggaatgggacaatctcctagtgttggacaactcctccaggatgggaaaagacacagaagtctacagggtccagggactcagatccaagtccactccatccactgctcagaggtggagggcggcccccgagaccgctgtccacggtgctgaaacacagcattgcactaatgcggtgcttctccaccttggctgcttattagaatcacttggggagcttaagaaaaaaaaaaaaaagccaat

SEQ ID NO: 19210 - DNA, 1693 bp, Homo sapiens
  ENST00000625683
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctgagtctcactctgttgcccaggctggagggcagtggtgcagtcactgacagcctcgacttcccaggttcaaatgatcccccccaccagttcagcctcccaagtagctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgtgagtgctgctgctctgagcccaaggaatcgtcctcctacctccctggccctgtttcagagtctctgccaaactccccctccctgcccctcagaatctcagagtggtgtgggttgggagtagcttcccttgggagggaaaatctctcttagtttgggggcaatctcttcagagtgaggtaacttttctggaggagggaacaatttaccttgtaagagtcaacttcttgctggtagggtggacttaggaagaattaagtgggaatgagttccaaagcaatgaatgctgtctgtggtagggaaacctttcctgggtggggacaacctcctggaatgggacaatctcctagtgttggacaactcctccaggatgggaaaagacacagaagtctacagggtccagggactcagatccaagtccactccatccactgctcagaggtggagggcggcccccgagaccgctgtccacggtgctgaaacacagcattgcactaatgcggtgcttctccaccttggctgcttattagaatcacttggggagcttaagaaaaaaaaaaaaaagccaat

SEQ ID NO: 19211 - DNA, 1224 bp, Homo sapiens
  ENST00000626937
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 19212 - DNA, 2445 bp, Homo sapiens
  ENST00000616202
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctgagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 19213 - DNA, 6061 bp, Homo sapiens
  ENST00000243964
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattatacccttca

SEQ ID NO: 19214 - DNA, 583 bp, Homo sapiens
  ENST00000627290
gtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgagcctcctagcactgacaccctccctccataggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatgga

SEQ ID NO: 19215 - DNA, 1549 bp, Homo sapiens
  ENST00000372315
gtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgtgagtgctgctgctctgagcccaaggaatcgtcctcctacctccctggccctgtttcagagtctctgccaaactccccctccctgcccctcagaatctcagagtggtgtgggttgggagtagcttcccttgggagggaaaatctctcttagtttgggggcaatctcttcagagtgaggtaacttttctggaggagggaacaatttaccttgtaagagtcaacttcttgctggtagggtggacttaggaagaattaagtgggaatgagttccaaagcaatgaatgctgtctgtggtagggaaacctttcctgggtggggacaacctcctggaatgggacaatctcctagtgttggacaactcctccaggatgggaaaagacacagaagtctacagggtccagggactcagatccaagtccactccatccactgctcagaggtggagggcggcccccgagaccgctgtccacggtgctgaaacacagcattgcactaatgcggtgcttctccaccttggctgcttattagaatcacttggggagctt

SEQ ID NO: 19216 - DNA, 1105 bp, Homo sapiens
  ENST00000539566
tcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggacc

SEQ ID NO: 19217 - DNA, 100 bp, Homo sapiens
  ENST00000636324
ccgcgccgccaccatgctaaacaacctgacggactgcgaggacggcgatgggggagccaacccggatccctgacccctctcccttctcaggtgatggcaa

SEQ ID NO: 19218 - DNA, 100 bp, Homo sapiens
  ENST00000637831
cacaagtgatgcagctcattgatggaaatgataaggacgatgctcacggccatctccatgagtgcaattgcaacgaatggtgttgtgcctgctggtggct

SEQ ID NO: 19219 - DNA, 100 bp, Homo sapiens
  ENST00000637863
ttgagaagaaggacttggcaggagtagaagttggaacaggtccagggagcagctcagcagaagagaacctacgatgctcacggccatctccatgagtgca

SEQ ID NO: 19220 - DNA, 363 bp, Homo sapiens
  ENST00000608594
ggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctgtatcctgcacagctgtgctgggaccaccctcgggggagggcaagagggagggcagctgaacttgctgccttacctgctggtgcaggaagggtggggagggggaggactgaaccgtggggattctcctttatc

SEQ ID NO: 19221 - DNA, 432 bp, Homo sapiens
  ENST00000626144
ggcctggttttcagtatcaggaaattagagaattattttatcaaggaaaaaacaatggaacatttggggctctgcctcccctgtcacccttacagaacttagtcctgtggcaggcacacagttggttctgtagttggtatggagacctgccctggaaatccaggcagcactgctcacctggcatctcctgtccacatcattccaggtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctga

SEQ ID NO: 19222 - DNA, 572 bp, Homo sapiens
  ENST00000628413
aacatggcatggtcactgaccagtggactgaggactgacattggaccatagtgctaggcagagccttgctgtgccaaggttaacccttttgttgccagatgaggtctggggttctggagaggaggtggggcaggcagatcagtggtgcagtagctatttggtctcaaatcatagcaatattttaacaactggtacagttccagaaagtgcatcctggctgaacatcatctctggtgatagctctttgcagggcatgggtggtgactcccagcagagctggcaccaacctatgtcactccctagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataa

SEQ ID NO: 19223 - DNA, 100 bp, Homo sapiens
  ENST00000637437
atcccgggacgccaagcttgttttgctcaacatgcctgggcctccccgcaaccgcaatggtgatgaaaactagtttgagagcgaaagtgctttaggccca

SEQ ID NO: 19224 - DNA, 6166 bp, Homo sapiens
  ENST00000616933
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctgagtctcactctgttgcccaggctggagggcagtggtgcagtcactgacagcctcgacttcccaggttcaaatgatcccccccaccagttcagcctcccaagtagctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcggggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctcccagctgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 19225 - DNA, 2955 bp, Homo sapiens
  ENST00000616201
gtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccatatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtgttacttttttagactcccgtctgcacaaaatgcaataaaaataattttattataccctt

SEQ ID NO: 19226 - DNA, 2831 bp, Homo sapiens
  ENST00000430155
agttgccaggggagattgaaaagcagcctatgcgcagagctgcagctggagggcttgcggtgggacagcttccaggagagggtcccgcaggagaggaaggggcagccctggggaaggcgatgcgtggaggaggctgctcaccccattccccatctgggtgtctttcaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcctaa

SEQ ID NO: 19227 - DNA, 3447 bp, Homo sapiens
  ENST00000393469
tccagagcagtctccctgtccagatcaccaggatccctgcttgctggagaatgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcct

SEQ ID NO: 19228 - DNA, 3045 bp, Homo sapiens
  ENST00000473262
gcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgaagaagcttctctgcccttcattgggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctg

SEQ ID NO: 19229 - DNA, 1949 bp, Homo sapiens
  ENST00000465475
gcaagacgtgactttgcttctccttccccttctgccatgatttgtgatgcctcctcagccatgtggaactgagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatataga

SEQ ID NO: 19230 - DNA, 2989 bp, Homo sapiens
  ENST00000469902
agccacgtggcggcggggcggggaccgggcgggccgggcgctgggagctggctgtcccaggagcagagcagtctccctgtccagatcaccaggatccctgcttgctggagaatgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacaccc

SEQ ID NO: 19231 - DNA, 1753 bp, Homo sapiens
  ENST00000479352
atcaatccagcactgtctagagattaggagctggtgatgcaagtgcctgtggcgaaaccaatgcatcgcgccgattataactgataagctcagccttcttgtgggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgctt

SEQ ID NO: 19232 - DNA, 1070 bp, Homo sapiens
  ENST00000483944
ctgccatgcaagacgtgactttgcttctccttccccttctgccatgatttgtgatgcctcctcagccatgtggaactgagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgctt

SEQ ID NO: 19233 - DNA, 567 bp, Homo sapiens
  ENST00000461616
aagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggtctgtgccaatttggagccagtaccagaatggatgagtgtccagagtcctgggaggtgccaagggtgtcccattcctggctgggcttgggcctggattgtggcatgggaacctaacaactgggcacctccgggagactcagatgttgctcctgcgtgcactccaccacactcggcccccagattcggctcatcagaagcttcctctaggctcatgtcctcttcccttcttatcctcagtcatcaagaacagag

SEQ ID NO: 19234 - DNA, 805 bp, Homo sapiens
  ENST00000485954
cccatgtgcaaggatgacatgcaaattcgtgaagtgttccatatttttatatatatttaaaagtaaaaaaagaaacaaaacaatggtaccccttttttggtaagaaatatgccagaagagaaatagtacaaaaagtgtcctcccaagccagctggggaagcttcatgactggcctttctctcattctgatacaagttccctttggaaacagaaggttgagtgagggaattggatggggctgggtgaggtgagtcgggggcagctctgttctgctcttgggttttgcaggtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcc

SEQ ID NO: 19235 - DNA, 776 bp, Homo sapiens
  ENST00000479231
attgtggttggccagtttgttctcaaagtgtggtctctgggaacgcatgcggaatccagatttctaggccccaccccaagcctactgaaccaggaactctgaggaggggcccagaagtttgtgtttagcaagccctgcagctgagtctggcagacgcttcatttgaggaccactgtgcaatccatatgaaatgtggtggtggattcagctgaaaccatggaatgaatgggggcgaggctggggatgtggaaactgtatcccagggatcagatctagacgactcagtggatgattgcatggggtgcaggtgggtgggtgctgggggggtagaaaggcacaggagcaggttctggcactggcgaatgaaaccgcttctcacacaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctctta

SEQ ID NO: 19236 - DNA, 561 bp, Homo sapiens
  ENST00000465777
aggatgcttttggagctgggagggctttcctcctgagcctcctccaacccacaaaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgacccc

SEQ ID NO: 19237 - DNA, 586 bp, Homo sapiens
  ENST00000495105
aattagcctcctcaatgaaaaagaaagagggggaggaagaggaagagaaaagaagaagaaaaccctgaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtga

SEQ ID NO: 19238 - DNA, 576 bp, Homo sapiens
  ENST00000485849
atgaaatcttgcaccgtctcacccgggacatgaaccctgctttgtccagtgtggccacaccgtacacaccgcctgccatcagtcacttagtacctggcttggttatcaggtcaactgtcaagtagcagagggcttgagctcgaggccaataatagccaagtgctatgtcacgatgcctgcatcatccgcctcacttctcgtcacgtaggcgttttatcatcttacatcatcacaagaagaagggtgcatacagcatgaacatggtttcattggatattcacccgaactgctacagaacaacacgctgcccgattacagcccgggggaatcttttttcactgtctttggggttttcttcccagcggctacaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatgg

SEQ ID NO: 19239 - DNA, 622 bp, Homo sapiens
  ENST00000479826
ctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccctgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgg

SEQ ID NO: 19240 - DNA, 493 bp, Homo sapiens
  ENST00000462437
cagggtaaagggtttcctgaagtttctacctgctctaagtttctacccttgaggctgattgactagtccagtgagatcaaggaaatgaaaggcatttcacacaccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccat

SEQ ID NO: 19241 - DNA, 439 bp, Homo sapiens
  ENST00000481760
cgcctcctcgccacctgggcccgagactcccggtgctggcgtggcaggggtgcccccgccgggacgggacagctgggacccgcgcagccgagccggggcagccacgtggcggcggggcggggaccgggcgggccgggcgctgggagctggctgtcccaggagcagagcagtctccctgtccagatcaccaggatccctgcttgctggagaatgacccagatgtcccaggtgcaggagctcttccatgaggcagcccagcagtgtgcagcacctcccaggacctcttgctcctgctctggtgacataagatgcctgcctcgcctttgccttccaccatgattgaaagtttcctgaggcctccctggaagcagaagctgctatgcttcccgtacagcctgtggaaccataagccaattaaacctcttttctttataaatta

SEQ ID NO: 19242 - DNA, 3435 bp, Homo sapiens
  ENST00000433363
agcgttggagtccaaagacgcctcccaccgccgccgggtggcagaattgggggcaggcgcgtcccacagaccccgaggggtggccccgccccagggccgcggggaggcgcccccgtgcggggcggagttgtcaccgccccctccccaatccccggggactgtggccccttcttaagcccgcggcgcctctagctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcggatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaagctcca

SEQ ID NO: 19243 - DNA, 5398 bp, Homo sapiens
  ENST00000574580
cttataggaaaatcagtggctatggttttttttttttttttttttttttttttttttttgcatttccttctgtcatccattgcaaagacgtaccagcttcagggtagtatggaaagatccctggtctcgcagtcagaagacccgagttcaagatgtgggatctctgaacatggcccttcagttctttcttccgagagctgtgctgatggccaagtaagatgagggctatgaaaagcctctgtagactgcaaaatgagcatgggagaggctgtcattattctggaattgggagacagatttacagagggcctgaacacaggattgaaggtggtgaatttccattcggctgcctgggcgtctgcatgtataaaaagcaaacctaagtggtttttttctcctccaagtgaagatgaaagtgttaaaaatagcaaggaggtgaaagtgttcaaaatagcaaagtggcctgtctcctcttctcctaagcagactgtccaaacagacgcccagtagaaggagcaccttttgatactgggcacgtggtggtgatgcctcctctctcctagcacaggccgtggctttgtcatctccagccctaactgggagcaccgagggttccaaccaggcaaatgcaggccctaacgggctctttgaaaacgggcttttctagaaccaggaacctcaagtaaaaactcccccagctacctctaaggcccatcacactcctgtctcacgcccacctatgagaaaggaaaaggtgatggtcattgagctgggctgcagaggagtgtgaggtgcagacaccatgaggtacccacagccaggaaaacgaggatggtcggggagacgcgccagcgaagagctgggcccctgcgtgggacccctcagtggttcccagggggcgtgggacttgcgcagtcctttcagagggctgtttaccaacaggaaccgtaacattaaacctgctcagaccccttgactcagcaatttcatgtctgggaatatatcttaggaaaataatcagagatgcctaccaacatatgtgatgatgatgtatgacagaattattatacaaatatatccatagtaacagggggtttgctgaaataaattatcatatattcatataatatgacattatcaggccattaaaaatcacagtttcaaagagtaataaaatgggaacatgctcatagtatagttttttaaaattgcagatggtatatggctaaaaatgtctaataatgcaaagatgtatacagaccttaatcctctagcctcctccctagagatgacctctgttaatttctcaaatatttttctggatattttacacactcacacactttttttgagacagagtttcactcttgtcacccaggctggagtgcaatggtgtgatcttggctcactgcaacctccacctcccgggttcaagagattctcctgcctcagcctcccgagtagctgggattacaggtgcctgccaccttgcctggctaattttttgtatttttagtagagacggggtttcaccacattggtcaggctggtctcaaactcctgacctcaggtgatccgcctgccttggcctcccaaagtgctgggattacaggcgtgagccactgcgcccggccattcatcttaatttttaaaaaatctaaccatgaagccttggttatcttggagagctttcctgattagcacaaaaagaaaaaaaaatccaattctttacagctgcatactattccattatttgtatgtgtcatattttatttaaccatcctgctattagtgaccattgagttggcttcctgtgttttgccgttacatggttgcaacaaacatgtttgcatgtgtctgccctcatgtgcatgatacatgattgatttgatagattttaggaattacatcattcattcatacactcagcaaatatttaatgagtgcctactctctgataggtgctgttggatgtggctaaattttaaagtgtagaatttaaaaggtggctaccaaattccatgtgcaaaatgaccccacgcatgtataaaaacacacacatccacagatttatatgcgggagagaagatgtggtccctggcctctaggctctctcagtctgtggcaagacagacagacatgtgcacgcggcactgtaaggttgagcacagtctaagtactcagcatggtctctggcacatagtaggtgcccaagaaatacatgtcgaatgaattgagggggtaaggccttctagggcaggtggcctctgacctcagccttcagtgttccgtaggtggaattatctgccagagacgtggcaaaagggagaggaaccaagactgaggcacagaggttcaaacgtacccggcacattcagagaatccttttcagaatcacgtccccaagagcttctgtgttctgtacggtgatgttgcagtgctgtttttccgcagtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtaacacagctgtttttatttactcccgtcggactataacgctgttgtcataagggatgccccatttatgaatgacagagtttcaaaacgatgtcatgtgacttgggaatgccacggaacatccagacctgtagccattgttgacatttataatgcagcttttcttctttttctgagatgatctcaagcctcacacactgttctttctctgaggtgggttatagactctcccacctggagaagcctgtgcaggcaccaggggagtccttggaaggggtgaaggtggggctgagggactcatatggccaaggatgaacttgacaaattagcaagaaccatgaagataggcagggcaggcttaggcagcagggggatgctaatgacagtcacagagatttgtaggggtgcctgaagaggtagaagcagggagagggagagagagagcactgcctgggagtagatgatgccttggaaacaaatgtagtcagaggaagaactcttcattagctctgtcacctttgctgggagaagggcagctttgcagctctgggctgggaaagaggcaagtgtttgagcccaagaggccagaaatgtacctgggaccaatcgggtgttcgttatctcagagcctctgctgggtatctcagggactccatgagcattttcaaaaaaaaaggtgggtcccagaaaccatggactgcaaacttgactccaatccccagtaaaatatctacaacagggtagtgaagcgatggttagtgaccatgagggaagcttgcagagcaggcatcagaaagagcctgaggaggtccacagggaagctggcacgtccttgtaggatagttaaggcactggggtgagcaatgaacctggactcacggaacactgggctctgtgaccgtttccctgaatggcctaagctgttgcctcctgtcacttctctgaggtcattttccaaatgcgcacgggcatagagaacccatccactctgcctacttcccagggatgccttgagcactgaggatacctgggggacatgaagtcgcactgtcctgggggtcgggacaccccagccagggacagagcatggcacagggacatcgaggcccagtgagccgaccctttgtcctcctctctgagagcactagtccccagcaggcctcagggtgctgactctgtctcttttccaggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcggatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcg

SEQ ID NO: 19244 - DNA, 3176 bp, Homo sapiens
  ENST00000293800
ctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacgtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggtcatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcggatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaacccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcg

SEQ ID NO: 19245 - DNA, 1738 bp, Homo sapiens
  ENST00000381074
actcgtctcgcccgccagtctccctcccgcgcgatggcctcggcgctgagctatgtctccaagttcaagtccttcgtgatcttgttcgtcaccccgctcctgctgctgccactcgtcattctgatgcccgccaaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaa

SEQ ID NO: 19246 - DNA, 1723 bp, Homo sapiens
  ENST00000573648
agctgcccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgat

SEQ ID NO: 19247 - DNA, 419 bp, Homo sapiens
  ENST00000570687
cccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtaacacagctgtttttatttactcccgtcggactataacgctgttgtcataagggatgccccatttatgaatgacagagtttcaaaacgatgtcatgtgacttgggaatgccacggaacatccagacctgtagccattgttgacatttataatgcagcttttcttctttttctg

SEQ ID NO: 19248 - DNA, 618 bp, Homo sapiens
  ENST00000572727
gccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtatgtctccgatgccactgtggccatctttgtggccaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgacgtaccagcttcagggtagtatggaaagatccctggtctcgcagtcagaagacccgagttcaagatgtggg

SEQ ID NO: 19249 - DNA, 2506 bp, Homo sapiens
  ENST00000574824
tttagcatcaaatcaaaagccatcatattttctagaaatgagagaccccaggaaagtggacctcagggccctcagaattcttctgcttggctcccttgagtggccagcttgggtgggaggccactccagtgggtttcattctgcagcatgctggagagcttccacttccaaacccaagttcacacatgcttctgtatccttcctgccaccttgctcctctgagtatggtctccggttgtccaaggcactgcctgtcctgggagtcacctgtatgtgaggcacccttggtgccttgagatatcatgtagaagccttggttcttctcagacaactccattcatgcaaactctccccctcctcctagcctgggtcccgggctttgtttttttttgggtccataatgtctgcctgtgtggacagcagcttgggccctggtgcagaacagctcctaggtcccttcttcaggctcctacccctgcccctgctcctacccccaggtgaattaggagccctgaggaggagcctggctgcagcgaggcccacagactgagagtagctgagctccttctgtccctagccttggacagctggggcatgtagagccacagagcagagtcaggccctgccctgctcacagcccaaggagagagcagacatggaaacaggtgctttgaacccagcacagcgatgattagagtagggggaaggattgagaagggtcaggccagccccacctggtgcacacactgagagcgtggtcccagaggagggatgttgtttgagcaggctctgaaggaccatgaggagtcttcctgatagacagcagagaagggagcaggggttacaagcaaagggagtgtttcttctgaatactgtttgtgtgatagctccactgcagcatggaggggtcaaagtgtatgtgcggggcggaggggagatggcagggttggagtggcagccgggagaatagtcacactttcccaagctccctccccagctcaccctacccctactctgcttagcccttctgaacttctgagaggtgcaacagagtttgggggtgggtgggaatttcctagccagaagtgggaagctggggctgcctgcacataggggtattccagcacaccctagggcaagctcatattgagttggcaccatctggatgcctgggcttcccctgctagatggtggggcaggggtgctccttagaaccacgactggatctgaggcctcttggtaaccccagaagcaagcagagtagacatcagtcatgggtgtgggagaggcaggagggagagaggaatggaggaagcaaagaagggaaggagggagggaggggaggctctaaaaccgtcatccctattccaatatctgatcttgaattggcctcaacacctgtgcatccctgcaggggtggacccagtccccagttgcttcccagggagtacgggggtggggtggggattctctggctttcctccctgcccctcctctgcaggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccccggcttcatgcccggctggctgactgttgcctgggtggagggtgagacaaagtaagtcttggattcaatagaaatcgctggcttagggccaggcgcgttggctcacacatgtaatcccagcactttgggaggctgaggtgggtgggtcacttgaggtcaggagatcgagaccatcctggccaacatggtgaaaccctgtctctactaaaaatacagaaaattagcgaggcatggtggcacatgcctgtagtcccagctacttgggagactgaggcaggagaatcacttgaacccaggaggcagaggttgcagtgagcccagatcgtgccactgcactccagcctgggcaacagagagagactccgtctc

SEQ ID NO: 19250 - DNA, 986 bp, Homo sapiens
  ENST00000572094
tcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatct

SEQ ID NO: 19251 - DNA, 538 bp, Homo sapiens
  ENST00000572352
ctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgt

SEQ ID NO: 19252 - DNA, 574 bp, Homo sapiens
  ENST00000576323
ccctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgc

SEQ ID NO: 19253 - DNA, 547 bp, Homo sapiens
  ENST00000575230
ctcactcgtctcgcccgccagtctccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcagggagacaccactcgagcctgcatccccactccaagctgtccctgaagtcagcatctggggactgggtggctctagtgtgtggcaagggacagtcctgatgaggccttcgtgccacgctccaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatggg

SEQ ID NO: 19254 - DNA, 3971 bp, Homo sapiens
  ENST00000321925
acacagagcagagtggggctctgagtatataactgttaggtgcctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaaaacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaaaaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 19255 - DNA, 572 bp, Homo sapiens
  ENST00000587601
agtatataactgttaggtgcctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatatcttctcaactagactgaactccttaagtgcaagaaatacacgcttagtaaatgtttgttggaccagacactgcaccttatgaaattaaagaccagaacattctcatggtagcattacagacactgatggcaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatgg

SEQ ID NO: 19256 - DNA, 2371 bp, Homo sapiens
  ENST00000502059
gcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctac

SEQ ID NO: 19257 - DNA, 569 bp, Homo sapiens
  ENST00000586951
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtct

SEQ ID NO: 19258 - DNA, 652 bp, Homo sapiens
  ENST00000589322
atctcctgagaagcactctcccttgtcgtggaggtgggcaaatctttatcagccactgccttctgctgccaggaagccagctagagtggtgtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttc

SEQ ID NO: 19259 - DNA, 1554 bp, Homo sapiens
  ENST00000415427
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgct

SEQ ID NO: 19260 - DNA, 1048 bp, Homo sapiens
  ENST00000535474
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttcca

SEQ ID NO: 19261 - DNA, 1390 bp, Homo sapiens
  ENST00000402943
atctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatgg

SEQ ID NO: 19262 - DNA, 1682 bp, Homo sapiens
  ENST00000588179
gcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaacc

SEQ ID NO: 19263 - DNA, 552 bp, Homo sapiens
  ENST00000586056
aagtgttttaaccaggacacaggaatatctgacagcattttctttgtttccaattacagctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttt

SEQ ID NO: 19264 - DNA, 2264 bp, Homo sapiens
  ENST00000436407
atgcttacaaagcgtggctagtatcttattacagaaaacagagcccacatcatgcatccttcttctcacatttcataaacaaggccaagggaaactgctgtggggcaacctgttgctttggtgttggtccccaagatgcagccctcacaatctgcccccaaacgtgtcagaacatgaaccccctcctccccctctggaagaagcaacctcagatccaacagcagagacacgcagcagaacaaaatctgggcattggtccctgtgtaggatggcttcccgttattttttttttaagcaaagtaaatgaacatcaaatttccatagtcagctgctgtctttctgcccactgagagctctttggtgaaggcaaagtcctccttcttcattagcggtctcccatgtggggccacatcttccctcaccaggaacccagtgggcgcgctccagcccccctcagcttgccttttgcgtggtcattagagctagggcacacgtcatgctgattcacatatttttgccctttgtcatgtattgagaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccat

SEQ ID NO: 19265 - DNA, 602 bp, Homo sapiens
  ENST00000589891
gtctttctgcccactgagagctctttggtgaaggcaaagtcctccttcttcattagcggtctcccatgtggggccacatcttccctcaccaggaacccagtgggcgcgctccagcccccctcagcttgccttttgcgtggtcattagagctagggcacacgtcatgctgattcacatatttttgccctttgtcatgtattgagaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaaca

SEQ ID NO: 19266 - DNA, 557 bp, Homo sapiens
  ENST00000590246
atcgcccggctaagcttggccctggcagatgggtcgcaggaacagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggag

SEQ ID NO: 19267 - DNA, 595 bp, Homo sapiens
  ENST00000591943
atcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgttgttgaaatctataccagtgggagttggtcagatctatggctgtgataatccatggac

SEQ ID NO: 19268 - DNA, 2846 bp, Homo sapiens
  ENST00000586142
atttgttagctatggtaaatggaacaatgatggggccagaaatatccatgaggaccatttgatcacagcctggcaacacagagaagacaggctggtttctctatgtgggctttcagtgtttctttggtagtgtcttatgtggctgtggcttcaacattccacaattatgccttccagggtctgatgattttggcgtttccctgcttcccaattgacctggctgtgctgttggctgttcttgcacactcaaggtggttttgccattggcttcctccctcagcctgcctctgggattatgccactgctattcttttttatctaccatcagcacaatgaaatcatcatttttgtcttcaaggtaccaaattctggtgatattggtgctttcttgcagctacttatcatgagaagtgaatggtctcatagtgaacacagtcatggttatagtgttcatacgttccagagacatgtttcctataattatgccctgcacatttttctatcatacaatccttagattacagctctttggttttcaacagctttgtccaattccatctttcccagtttctctaccttgatgaaatatccttcttgcctggttttacatatttaaataacaaattccaaaagtaaagagtatctgaggcagtcacatgacataaggacaaattcaagccatcttggacttgcagagggtggggagaccgtgtcaacacacacaattttaaaaatttcttccctttcaatcttttaaaaacaaaactttttataaaataaaaatgtaatttaaaaaggctacctgtcttggcaagtagctgatcagcctgcattggtgagcaggccattccataacctggtttcttgctccttaattgacagcatggagctaacgtacttaatttcagctctttctacgtgatttgactcattctgttaacattaactgtttttcagtcttctcaactagactgaactccttaagtgcaagaaatacacgcttagtaaatgtttgttggaccagacactgcaccttatgaaattaaagaccagaacattctcatggtagcattacagacactgatggcaaaggtactgtgggatttgggtttggctaataagctctgtggtggtgtttcagaaggaaaatggtgctctcttagttctatggaacatagtggtccagatcttctactgtaaccaggcccaaagctggctaatctggagggctctgccttagggatacttataagctctgtccttccctcaaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaacc

SEQ ID NO: 19269 - DNA, 1022 bp, Homo sapiens
  ENST00000589700
atggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggaggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtga

SEQ ID NO: 19270 - DNA, 779 bp, Homo sapiens
  ENST00000590377
ctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagccctgttcacggcctatcttggagtcggcatggcaaactttatggctgagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 19271 - DNA, 565 bp, Homo sapiens
  ENST00000591642
gtttttgtacgatgcttacgtagactttgaaatacatttccaaatataatctcattttttaatatgaatatgatctggaagttactagtgttatttatgtgcaagtgcaaccaaagctcacccaggaaatgtccgtgctgtgtctcttgccccacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcct

SEQ ID NO: 19272 - DNA, 577 bp, Homo sapiens
  ENST00000586854
gccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtggtgagtctcccacgcccctgggggagggctgctcatgactacaggatctcaatcaaggataagcagtaaaaacggactgcatgaaaaatcagggccagggttctggcttgagcccacttgctgtctaagtgtgtgaacaggacaagtgacgtcccctctctgagagcattaaaatcacctctgcctacctctctgatg

SEQ ID NO: 19273 - DNA, 554 bp, Homo sapiens
  ENST00000591541
agttctgacccctcctgtcttaacaggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaat

SEQ ID NO: 19274 - DNA, 3823 bp, Homo sapiens
  ENST00000619403
acacagagcagagtggggctctgagtatataactgttaggtgcctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggaggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgcggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaaaacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaaaaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacccgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctca

SEQ ID NO: 19275 - DNA, 3540 bp, Homo sapiens
  ENST00000586448
gtaagctgcctccatcatcctaaaaaacgaccatgctgaaagagctcctctgtatttcttggcagaccctttccagttttcatcctgggtgtttctgaacaggaacatatctcattgaagtatttgcacctctacctacagacaaggaaaaggcttggagcacctccattcattgtgccaacaggacctgaatgaccgattgtttcttgcttactacttgtggtcaactaagtagagattcataagacctttatagaaccactgacaacactgtgaccaaggaaacttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctgcccagttctttctagtgccttgaattccatcttcagcaagtgggacctcccggtcttcactctgcccttcaacattgcagtcaccttgtaccttgcagccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggaggcggtggggagcatccacccacagcaggcccaaaggtggaggagggctcggaggctgtgctctccaagcacaggagtgtatttcacatcgagtggtcatccattcggaggaggagcaaagtgtttggaaaaggcgaacaccaggaaagacaaaacaaagacccatttccctatcgataccggaagcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacgggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcaggcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtggctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagt

SEQ ID NO: 19276 - DNA, 4746 bp, Homo sapiens
  ENST00000255226
ttttttttttttttttgagacacagtttgctctgtcacccaggctggagtacattggcactatcttggctcactgcaacctccacctcccaggttcaagagattcttctgtctcagcctcccagtagctaggactacaagtgtgtgccaccacaccctgctaatttttgtatttttagtagagacagggtttcaccacattggccaggctggtctcgaacttctgacgtcaagtgatccacccgactcggcctctcaaagtgctgggattacaggcgtgggccgccgcacccggccatttgcttttgattttactggctcataggtggaagggacttgccttgcctcagatgaaactttggactttgactttcaagttaatactggaataagttaagactttgggggactgttgctaaggcacaattttgttttgaaatgtataaagaacataatatctgggaggggccaggggcagaatgatatggtttggctctgtgtccacacctgaatatcatctcaaattgtaatcccagtaatccccatatgttgagggcaggacccagggcaaggtgactggatcatgggagcggtttcccccatgctgttctcgtgatagtgagtgaattctcacaagatctgatggttttataagtgtttggcaagttcctgctccacaccatctctctcttctgccgccatttgagaaggtccaagtttgcttccccttcgccttccaccatgactgtaagtttcctgaggcctccccagcaatgtggaagttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctgcccagttctttctagtgccttgaattccatcttcagcaagtgggacctcccggtcttcactctgcccttcaacattgcagtcaccttgtaccttgcagccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggaggcggtggggagcatccacccacagcaggcccaaaggtggaggagggctcggaggctgtgctctccaagcacaggagtgtatttcacatcgagtggtcatccattcggaggaggagcaaagtgtttggaaaaggcgaacaccaggaaagacaaaacaaagacccatttccctatcgataccggaagcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacgggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcaggcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtggctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagtcccagctacttgggaggctgaggcaggagaatggcgtgaacccgggaggtggagcttgcagtgagccaagatcacgccactgcactccagcctgggcaacggagtgagactctgtctcaaaaaaaaaaaaaaggggaagtcaccaagaaagggatagaggtcagtgacatggtcatcacacaactcggtcatttaatatggcaaaacacaataccaagaactgtgcattagcccggaaggcaagagggttggttctgccccagctctgctgctaatgagcccctaccaggttgagcaagtctttccccactctccacctccatttcttaatcagtttcatgacagggaaggatttgaaagtcctttccacctcagaagtgttgattattctctctctcctataatctgatgaaatcagcatgacaacaagtaatttaagtaaaggacagaagggttacccaagaagaggcaggaaaatgttaacgttctataaagttttattcttgagtcataggaaaatgctctccagacgtggggttaggaacctaaattcactgaaaatgccaatgtgctttcctttacattacagaaatatttctggaagtgtcagatgaaaactgatctttatcaacactcaaatcatattataaacaaatgtgtttccctttgtaatattcataatcatactgtcattaaactgtttaagtttgc

SEQ ID NO: 19277 - DNA, 1729 bp, Homo sapiens
  ENST00000323329
atctctctcttctgccgccatttgagaaggtccaagtttgcttccccttcgccttccaccatgacttccatcgatagaagagtggctgtgacccgaaggaatgtctgacccccacagcagtcctctcctgccagagccactttccagcagatacaaactctacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcatcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgtgttctcggagaagttagactactactggtggcttctgtttcctgtgaccttcacagccatgtcctggatggagacggattttaactggagtaagagtggatgctggaagcatctgctacaataatccacaattgtctgctacaaaaccccacagagatgacagtgtttagattagagtgatatccatgaacatgccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggtgaatagccatgttcggggaagaaacgctctttgcctgacctgatgtcctctccctgtgttctctgctctggttcaatcagttgcagcactcaccttctttgcctctccttgcacctgtgtagaaccaagcacacctgtaactttctttccctgaagctgattttcattctctgccagaatctccataactatctattgtgcgacattaagggatgttggtattacagtaaaatttccggagttagc

SEQ ID NO: 19278 - DNA, 5673 bp, Homo sapiens
  ENST00000489711
attatatgcgtgaaccaccgcgcctgaccatggaatcagtttttcaatctgtgctcgaggtgttgtgttcttaactatcttctactcctttgcaaagataatctttcttaaacatagactttctaatcagttctctagcattgtttcattctgtctttggcatgttttcactttgctgtgctgtacttttacacattctttttaactatagcttcctgctttgctctggatcaggaagctattgaagctgacacccacagagttaaactgagttgctgaagccaccagctccccctcccagtccttcttttcagagtaggctggcagctgtcctaactgcctactaaagccaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacacaagataccttgtttaaattaacatgtacgctgcagaacattggtttggaaaaaactgttgagcagttcttccttgtaagtgctgagcttcctctctgaaacctcctaccattgttttttttcccctgtagctaacaagaataagtataacagccggccaggcacagtggctcatgcctgtaatcccagcactttgggaggctgagacaggtggatcacctgaggtcaggagttcgagaccagcctggccaacatggtgaaaccgtgtctctactaaaagtacaaaaattagccaggtgtgatggcaggtgcctgtaatcccagctactcgggaggctgaagcagaagaattgcttgaacccgggaggcagaggttgcaatgagccgagatcacgccatcacactctagcctgggggacaagagtgagacttcatctaaaaaaaaaaagaaaagaatatgtataccccctttttcatgtggcagatgtttagctatttggggagaactttcatggctcttccctaatcatcaagtattcaaggtaaagattctcggttcctgtaatggttcctcaccaggcataatttgtccttttaccatcctactttctgtcttctgaaaaacattctttatctgaaatacagcaattaatattaagatatcttaatatgaagtgcctggagtcaaatataacattccaaagtagtctgactggaagaactagcacctgcctttcttcaaacaatgcacttctgttaatgcagtgtaaggtaacatgagttgtttttggaaactacatcataatgtgggcttacattctagcacttatcacttaatgacagggatacatttgaggaatgcattgttaggcaattttgtcattatgcaaacatcatagagtgtacttacacaaacctatggtatagcctactacacatctaagttatatggtatagactgtttctccagctatatggtgtagactgtttctcctaggctacaaacctgcacagcatgttactgtattaaatgctgtaggcaattgtaacacaatggtatttttatacttaaacatatctaaacatagaaacggtacaaaaaactttacacattatatagatgtatcaaattattcatatgtgctctgaaaatgtctatatctgttatgtatcaattttttaaaaagtgaatgacataattcatttgaaaaaatgtggacacacaaattggaaaagaggtataaatgcagtattataatctaatgggaccacca

SEQ ID NO: 19279 - DNA, 2379 bp, Homo sapiens
  ENST00000295605
aaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaaagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctgg

SEQ ID NO: 19280 - DNA, 572 bp, Homo sapiens
  ENST00000469013
agattgcataattctcaagctgtgagctgcaaagacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaag

SEQ ID NO: 19281 - DNA, 546 bp, Homo sapiens
  ENST00000489886
attaatattagaatagctatatacaggatacggtagtggcactgaagacaggaagattatttttaacctatgaaaagggaggaaaagaatgctaaagctgctctggagtttgaaaggcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagg

SEQ ID NO: 19282 - DNA, 299 bp, Homo sapiens
  ENST00000489957
gaacagtctaatgcagtctttaataataggctacagagtttggatttcatcctttagagtctaaagtttagatataattgtttctcctttccaccacagatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagt

SEQ ID NO: 19283 - DNA, 586 bp, Homo sapiens
  ENST00000465060
ttttcagagggagaaaactatgtctacttggctagtggactaggctgtcagaaacaactgagatatgtgttgccattgtatctgaaggattatttgttggtgattctgacatgtgttctttgctctaaggaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggag

SEQ ID NO: 19284 - DNA, 562 bp, Homo sapiens
  ENST00000469422
ttttgaaaagctggaattgtgtagaaatgctcaatttcctgaaaatggctgaagaatgaaaatacaaaaaggatggatataagatcgtagaatgctgtagttagaaatatttacttgagactactgacaagtccatttccattttctctttccctaagaacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaact

SEQ ID NO: 19285 - DNA, 2508 bp, Homo sapiens
  ENST00000368851
gcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagata

SEQ ID NO: 19286 - DNA, 646 bp, Homo sapiens
  ENST00000439288
catgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcactgatcatgaatattactatttaataaaga

SEQ ID NO: 19287 - DNA, 734 bp, Homo sapiens
  ENST00000465319
catgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagaataaggatccccaacccctgtgccacagactggtacgggtccatggcctgttaggaattgggctgcacagcaggaggtgagctgtggttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcactgatcatgaatattactatttaataaaga

SEQ ID NO: 19288 - DNA, 912 bp, Homo sapiens
  ENST00000419619
catgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggcaaaattcagctttgttatactgaaatacgaataattaatgtctagactggggttggtgcctcacgcctgtaatcccaccactttggggggctgatgcaggagttcaagaccagcgtgggcaacataaggagacttcatccctacctggggaaggaaaaaaaaaaaagaaggaagaagcagtgtctaaagtatctgcccctggcaacgtttgttcaaaagtgttcattatgtttcttccttttttcttttgtggctgaaaatgtatttacaattcaccgtaaatgataaaaatggcattggcacacatattt

SEQ ID NO: 19289 - DNA, 10051 bp, Homo sapiens
  ENST00000368850
ttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatctcaacatctgctgcaatttgactgttcagatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaatctacattttgaccatactaccctttcatgtccttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagattgcttgagcccaggagtttgagaccagcctgggcaacatagcaagatcctgtctctactaaaaataaaaaaaaaaattaggccaagcatagtggctcatgcctgtaatcctagcactttggtagtccaaggcagggggatcacttgagcccagaagttcaagaccagcttgggtaacataatgagaccctgtgtctacaaaaaatttaaaaattagccaggcatgatggtgcccacctgtagccccagctactcagaggctgaggtagtggaaggattgcttgagccttgagatggaggctgcagtgagctatgccactgtactctagcctgttcaactgagcagaaccctgtctgtaaaagaaaatcaaaaacaaaaaataaatgttaaattttgttttaagttttagcacagactcccctcaaaacaccttctccccaattttacagaaagtaatttaaaaatgaaaactttactctgtaaagacctctacagtgtttttcttttcaaaatttggctgattttaggaaaaaagtgatcatctgaaactaaaagaaattgcttggttagtttccatattaaaacagcagtgacaagtatatataacttagatctcagcatatgtgtttgtatattaaacttcacatatgtagttttcagtttaatggaatgaatcaaactggatctataacactgaaaaagttctattgtaatagactcatacggagaatactctgctataataatataaaattaagaagaaaaagtataaacgtaagatgctaaattccataaatgcatatttagtactatgttttttgtgggaaaagttctaaaagtttaaaatgcacaaagaaaatgaaaaatactaatataaaaatttgtgctttaatctagtcaaactaaatcctttctaatttctgaatgaagtgttactgctgcaataaagtgacctgataagcctaaattttttgtgttcaatccagacacttttctgagagtctgaaaagaatacagagtcagaactctgtttttatctcctcatcctgtttttgataagactcagaaaattctcaaattcgaaaggttctggcatttgaggccaaaaaaagcatgaaagggagtaacattcctttttatagatactctagattggatactattgtaacagatggccaagaaacttccagaaacattttggttaaattttattgcaatggatattgctgggatccatccatttaagcagtaatataccacccagattattgatactttatgcaagatgtgttcatctctttgatcatatttacaatgcttactccatagccctgctacaagacttaaaatttccactgaaaattgcatagttcttgtattaagattcaaattctggctgggcgcagtggctcacgcttgtaatcccagcactttgggaggctgaggcaggcggattgcctgagctcaggagttcgcaaccagcctgggaaacacggtgaagctccatctctactaaaatacaaaaaaattagccaggcgtgtcggcatgcacctgtagtcccagctactcgggaagctgaggcaggagaagaatccaggaggcagaggttgcagtgaggcgagattgcgccactgcactccagcctgggcgacagagcgagactccatctcaaaaaaaaaaaaaaaaagtaaaagtacacacagtttaaaagtaaacatgtttacttcggataattctaatccttttagctgcatttaagaatattttaatttatacgaatgttacttgaaattggcctatgtccagatgacttttgatgttaaatcaatggaaaactgaatagaaaatatgacacgagatcggggagggggaaggcaacctatagcatgggtggctctgaggagttcctgctggtgcactttcatgccctttcttatgtaccttttgtcttactcttcttacattattcttatcctcatcattttttcatttccctttacttcctcctatccttcaaaaacctcctgaagagtccattaacatccatgcttagttccactggttgcatggctgtatttcctactgatccctgtagtttcactgaatggatccccacccaatttcgtgtatcctggtgaatggctttctctcagccttcgacttagttctaatgatctacattgaatttaaattacatgactgaaatatttaagggaagaaataaatttcatacaaattagtatcttttatgctaacatttaaaactgtatttaaatttttaaggtaaatgctttggggaaaaaaaaaaccattgccaagtctttagcatattttcagagagcgtaattttttactttgatttccagtttcactaaggtttcattaaatcttagttccgagagcccagcatgaagggtgactgggaatgtagtgtgcctctctgatgcagttcctaatgattgttcttcagggaccttccttaggttaggttacattttctggtgaatggtgttagagtaaattcccagagtttagagatacaagtagaaatgcataagctaattagctccaattttataatatgtaaacaatttaaacaagtatttaaaactttttaggaagtctctaacactgaaaaaaaggtcattgttgctggtataaacattaaggagcaacttttacattaggtcaaagattgttgcttttccagtgtgttgtcttaaaaatagaaggaaataaaactattaccttctttttacatctatatgtttttataatttgaaaggcaagtagtatcttggtgaataagaaatgcatcatccataacaatttaattaactcttaaaaagaccagctttttgtcttgttatgaaaacaaaacgcaatttgtcattcataatggtaatgtggaataagaatacatcgtagaaggaagacttgctactttactgacttaatcattagttctaaggccatgtgtggcggctcacgcctgtaatcccagcactttgggagtccaaggcggtaggatcaccagagcccagggttcaagactcagcctgggcaacatagtgagatttcgtctctacaaaaaaaatttagccagcttggtggcacatgcctgtagtcccagctactcaggaggctgaggcaagaggattgcttgagcatagcaggtcaagtctgcagtgagctgtggttgcaccactgcactccagcctgggtgacaaaatgagaccttgtctacaaaaaggaaaaaaaaatttgttctgctctactatacatgctgacttttgttgatagcttggtctaaaaagactgtctagagctgaatttaagaatggttctggagcaaataataacaaggtagacaagcaggccctgggctcactataatttcatagccacgacctgtttattattagttggcagagattaatgctttgtgttataaatatactatagaacaataggtcacgattctcaagaacaaagccgaatgctcgcagttaagtgtgaagcttgcataagtgtcggaaccacaattatggacccaccatcaatgtgcattttatcagatgactcctcctgagacagtaaagactcctggaaaattcatgacatctttgaatcactcagaaaaatcttgaaactcaggacgtagtttacttagcttgccttttttaaaattatcaaattttaaatcgtaaactttgtcttcacttccacacgttcaaggacacctcttttaaagttcagtgttccatactaaaggggtgtaatcttgctttctggggaaataaaattccccatggtactatattcctgacagatataaaataacatgaggctacctcatttttgaaatagatttcaatatttttattagtaagttggaaagacagtaggaacaaaatgaaacctttctaagtacttgatgacacccacttgatcatgacaattcatctacctccgctttccgtgtccagctgaaagcccagctgagtcaactcctgcttcatcagaagggagctaatggtgattctgggattaaaaagcaaggggggtgcaaattgttagtggggtcaaaatatcagtaaaatttcttaagtgctttgttctgataaacggatgtaaaagtaacaaaaaaggaataacaactaatatggcctgtggatctgacaaagaaaaacctgaagaaattcagaatctagatacacttagattctaaattagacacactcagattctaatgaacacttagaatgcttcgccagtggcttttcaagttacactggaagcttgattatgaaaaagttttgttttcattggcaagagggtagatgatcagtgatgacagattgtacagctgtgcccaaacctgacaacttacacattaaactcctgtaagagacactccttcctagtagaacaaggactgggacaatgaatttttgactcactggagttttttaaaatgctgttcttgagtgtggcaatagtgtaggagttaacccagtctacccaaagaagttgctttgcctttcaatatgagtgctataaaaagagtattttggagttcaatgtccctaaacatgtatgcgataggaactaccaatataaaataacacttagaactcaaattagattggtaatactattttggagcctgtgatgtatgacttttattctttactagatatttttcagtatccgtcattagaagagtcagtttgttaaatattttaaatgtgtaaacacaaaacctttctactgtgatcttccctaatgagtcaaagtatctttcataattcagtctatattgaaatgttatttcaggaatggagggtttgttattaatagtgctgggccgggcacggtgactcatgcctgtaatcccagcactttgggaggccgagacaggcgaatcacctgaggtcagatgttggagaccagcctgaccaacatggagaaaccccatctctaccaaaaatacaaaattagccgggcgtggtggctccatgctgtaatcccagctactcgggaggctgaggcaggagaattgcttgaacccaggaggtggaggttgcagtgagccaagattgcaccatagcactccagcctgggcaacaagagcaaaactctgtctcaaaaaaaaaaaaaaaaaaaatagtgctgcattttgaccctggactatgaacagactgtatagttggtgcctcttttttttctaccaaagattattagatcaagattggtgctatacttcatgttcctttcaaaattatttttcttttaaaaatattaatatacaacacaatagaaaatgtatacagccagcaacgttatgcatgttgcatgttatatacatgactgaggaaaaaagctcacctatacagtgattattgagttccagtatctagttagaggtatgcaatttttgttaacatataagactttaaattacgaaactcacaagaaaatgatcaccaaatgagaatgttctaatgaacacaacctcccaaggtaataattttaaagaaaaagtcccttgtcaatgtttctagcacaaagtgagggatttaaatatattctgtaactttgaggcaatgtgaaaaagttatatataatagcttcctattgagctggcttatgtagacatttggacatttgaaactatttcgcaactttcaggctaaaatcagagttttgagagtcatcaatcttaaaacatggataatgagttatttgcacagttatatttttataattatttgaaatttatcactgaaagtatcattgtttgtctttcagatttaacataaacaataagtactgcggctgggtcactgtcagcaaatctcaggtctatgatttatcaagggctctcagcaccatcgttggtctgattgtgtaacacctaagtaaaataacatatgggtctccttggccaggcgccgtggctcacacctgtaatcccagcactttgggaggccaaggcaggcggattgcttgaggccaggagttcgagacatacgggtctctttaatgttctgtaggtaggattcagatgaattgagaatgacaggtttctttttctttctttgtttcttttttttttttttttttgagatggagtcttgctctattgccaggctccatatagtggcgcgatctcagctcactgcaacctccgcctcccgggctcaagtgattctcgtgcctcagtcttctgagtagctgggactacaggtgcccactaccacaccggctaatttttgtatttttggtagagatggagtttcaccatgttggccagactggccttaagtgatccacctgcctcagcctccccaagtgctggaattacaggcatgagccaccatgcccggctagagaatgacaggtttcagttgaattcttctcttttaaaagaccctgacttaactgtattttatgaggattttataaatgtaaattaagaagacaatacacactctcattttcctaattagaaagactatgcattcacaatccagtacactggatttgctctggtaactaatgataacacttttctacgttaacatgagttatatttggcagagagaatggaagcttgctaatcagaagttacattagggtgagattaaacatcactctaataataacttctgatgtaacttaatgtggtttgagatgtgtaagattgtagaggcattgcacaatgcttgataaaagttgcattttgcttttgttcttccaccagtttattttagccttaaagttatagctacaacaaattgaaccctgtagttattactgaaagagagtgtggatattttaagtatctcctagtataatatgacattgttcatgtggacttattttaatgtttatttgaaaattaattttttaattattttgtatattttgagttagaaaaacacactttatcttagacaccaaagccaaattattccaagtgtatgctatacaccgcagtgcagctctgcttctctcccaacctaccctggggccatttttggcacaatagttgttcaaatgtagatcactatgctgaatgctcatgctggatttgaccagtatgcagtattttagtactttttaaaaaatgtatgcttctttttgaagactataatttacaatttttttaataatgtgcaatttaatatagataaccaaaatctttttaatgaaaagatctttacaattgcttggaggataagattattttactgtggaaaaatgtgatactcttagtaaatgcaataaaaactttttagcaaattcc

SEQ ID NO: 19290 - DNA, 1231 bp, Homo sapiens
  ENST00000612036
agtcgggggtgcggggctgtgacctagaggcttcagtgtcgatccccgaggtgttcgcgcgcgccagctgtcctcgcggccgcctgcgcgctggccgcctgcgcgctgccagcccgcccgcccgccaggggctccgccgccctcgcctcggcctcgttagcccgccaggagccccgcagctcctccgggagcccgctggtaactcgcgtccctcgcgcttctccggcgcctgaggggcccgcctcgggccatggtgctctcccaggaggagccggactccgcgcggggcacgagcgaggcgcagccgctcggccccgcgcccacgggggccgctccgccgcccggcccgggaccctcggacagccccgaggcggctgtcgagaaggtggaggtggagctggcggggccggcgaccgcggagccccatgagccccccgaaccccccgagggcggctggggctggctggtgatgctggcggccatgtggtgcaacgggtcggtgttcggcatccagaacgcttgcggggtgctcttcgtgtccatgctggaaaccttcggctccaaagacgatgacaagatggtctttaagacagcatgggtaggttctctctccatggggatgattttcttttgctgcccaatagtcagcgtcttcacagacctatttggttgtcggaaaacagctgtcgtgggtgctgctgttggatttgttgggctcatgtccagttcttttgtaagttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaattttcaattttgccatcttcaaggtgacagcttatgcagtgtgggcagttggaataccacttgcactttttggatactttgtgccttatgttcacttggtgagtatgctccttcactgatcatgaatattactatttaa

SEQ ID NO: 19291 - DNA, 3616 bp, Homo sapiens
  ENST00000377905
ttacctcccagaattagacaattgcaaagagcttagaatatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggagactgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagcagaaagaaagaaagaaa

SEQ ID NO: 19292 - DNA, 3699 bp, Homo sapiens
  ENST00000439485
ttacctcccagaattagacaattgcaaagagcttagaatatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaagggatagtggatgaattcttcccgctgttgtcaaactaatgtatatggactcaaccacagggatatccccagagctcctatggaacactagcaaattttgtgtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggagactgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagc

SEQ ID NO: 19293 - DNA, 2331 bp, Homo sapiens
  ENST00000397076
tcagtaagtaaatgccagtccctaggaagagagaaccaaaatgtctaccggaccagatgtcaaggctacagtgggggacatttccagtgatggcaatttaaacgtggctcaagaggaatgctccaggaaagggatagtggatgaattcttcccgctgttgtcaaactaatgtatatggactcaaccacagggatatccccagagctcctatggaacactagcaaattttgtgtttttgttcagtccgacatgggctggccctcatcttgcagctctgtaatttttcaatttacacccaacaaatgaacttgagcattgccatcccagctatggtgaacaacacagccccacctagccagcccaatgcttccacagaacggccctccactgactcccagggctactggaatgaaactctaaaagaatttaaagcaatggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggtaagggagagactggacacaggggtgaacgtgggaagctcagagcagccttcagtttactctgtgtttgtcctcctaccccaggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtagggacctcttttgcctcatcctttcagacactcaattcaagtctagcagccctaaatctactctgatgtgaaagtaaaatgtggcaggtacaacaggttgcaggaaatgtcagcaccagctctacatcctacatctaaataattcctggaagagactcaaagctggtggaccattgtgaacttagtttttctgggcgtgaacaagaggagtcagtggccatgctcagagtcaactgagggagactcacacaaacctctctctgttgaggaatgcagcacttgcctaaggcggaatcactgaaagaaatcttgagattctatagggtatgctcatgaaaatctttaatgaaggcaaaggacacaggactgcaggagaaatatctgtctctgatacagtaaaaacagttgactgagacttccaaacatagctcccagggtgctgtcccagtcaacaggacatccttcatcttcagataatgaaccaccaagaaatgtgagagatgcccttgtcacaggggagccgacgtctcatctggtgaggggtcttttatacccacggagggtataaaagttacaagatcagactcaacagcagaagccaaaacaacaacaacaacaacaacaacaacaacaacaacaacaacaaaaaccttacaaaccaggtgcagaccatcaatctgaccatcttgcataaacaatgttgacaagttaatagaggttacccccttgggagtaccagtccctagcacaggattatactaatcattggtcagtacatttcattcaggtttcaccaaggcttacacaattccagtcatctccagaggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccg

SEQ ID NO: 19294 - DNA, 2973 bp, Homo sapiens
  ENST00000221485
tgtgacagcccccgggccgcctgcacttgcagcctccttccccccgagcggagctgcggggccggccgggccggggctggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagccaggggtgttttttcccagtgcagggttgtgtctttgtgtctctgtctctgtgactgtaaatcctgccctgccccactcccaataaaagctttggtgtataggc

SEQ ID NO: 19295 - DNA, 2237 bp, Homo sapiens
  ENST00000600601
gaactcagagcgcggacagatcccagaggagcagagaaataacacaatggggagactatggggtcgcagctggcactggcgggccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctga

SEQ ID NO: 19296 - DNA, 2024 bp, Homo sapiens
  ENST00000600672
cagtcccatctcaggttcctccctgaatgtgatccttttttgaaaccctgccactgcctacgtcccactgcatgtgttgtgtcccttatctaaagacccacagggtctcccaggctacggtgcagtggggccattgctctgtcgcccaagctggagtgcagtggcaccatcactgcagcctcgaactcctgggctcaagtgactctcctgcctcagccttctgagcagctgggactacaggcgtgcgccggcatacccagctaacatttttatttttatctttgtagagacaaggtctcactatgttgcccaggctggtctcggactcctgggctcaagcgatcctcctgccttggcctcccagtcctgggagtacaggcgtgagccaccgtgccctgtcctttctcctattttaatttcagcataggccttgcccctgcatcagaaaagagtcctgatttgtgcctttgtcctacctgaagttcctccccttgctcccttccaatctggtccgcccccttggctgcttcgtgtccccgcctggaccctgtgcaggtcactccgcaaacgctcataagctggatataagtggagagagtcatcatcatacatgggcccctaggctttcatggaggcaaggaagcaggcaaagcaaggcgtctaggtggtgatggactctgttgttaaggcagcataggccctagcaacgtggaagagcggagtttgtagactttaattgacagaaagatagtgtgagctttgattggcaggcttttggaggtgggaggggttcctcgttgctgataggtcgagacgctaagtctgtgggtgctgattggtggagcggcagagcctggacagggcggctgatttaatgtacattttggcccgcagaaagcccagttcagctgggatccagagactgtcggcctcatacacggctcctttttctggggctacattgtcactcagattccaggaggatttatctgtcaaaaatttgcagccaacagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtg

SEQ ID NO: 19297 - DNA, 553 bp, Homo sapiens
  ENST00000596689
tctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaactacactgtggtccctgaagggacgcggagaagccctcagccccgctccccgtcttagcggccctcccctcgcccccacagaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctg

SEQ ID NO: 19298 - DNA, 2785 bp, Homo sapiens
  ENST00000598018
attctggatctctgttctcatctctctgcatctatgttctatctcctgggtttctgtccccgcctctctttgggactctgtctgcttccttctctaggtttccatctcttccctctctgggtctctgtccccctatttctaggtctctctccccctctctctgggtctctgtctccctctctctgggtctctgtcatcctctgtgtctctgacccctccatctctgggtctctgtccccctctctatctgggtctctgttcctctctctctgggtctctgtctccctttctctctgggtctctgtccccctctttctgggtctctggcccgctatgtctctgggtctctgtcccgctgtatctctgggtctctgtccccctctctctctgggtctctgctcccctgttattctctctccctctctctgggtctctgtccccctctctatctgggtctctgttcctctctctctgggtctctgtctccctttctctctgggtctctgtccccctctttctgggtctctgtcccactatgtctctgggtctctgtccccctgtatctctgggtctctgtccccttctctctctgggtctctgctcccttgttattctctctccctctctctgggtctctgtctcttcctctctagatctctgtccccctttcactggatctctctcccttcttctgtctgtgaccccctctctctgggcctctgtacaactccccccatctctgtcaccctctttttgggtctttctccacctgtctgaaggcacctctctctctctgcagcctctctctgggtttgaggcagccctccaaataccctcttcgtcatcacagacttgattctggatccagaacgggcgggggcgagagtcacgctggggaatgagccaatccccctaccagggccatctgtcccctgccaggacaccacccgccactccccctccctaccccctaggctggcagcctggactcaaggttccctagggatgcctgggacgggctgctggattcccagggtcctggacatctccccaccccctagcaaacgtggctgagaagcatctgttcttttgacacctttgctgaagcatctccttagcaccttttgcttcctcgaatagactcttatccgggagaggcggctggagagtctttgggcctcggagtgggggcacaggctcttgaatcccaaagggttgtctggggtctaagtctcctgagttgaaggatttgacagagctgggagagggggactgaagaccgtcaatgtgaagaaggagggggctgggggcctgaattcccggtctgagggagatggaggatttctggatcaggggggcgaagggagccagggacctggactcttggtgaaggaggaggtgcgggcttagaattctggatgttgaaaagcaggttttgccctggatcctggtcttgggggtgagggggctgggggcctggacttccgagtctctggctcttgctgtcccgcagccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacggtccgggaccaaatcttcggggaaggggcggggagagatagcaagccacgaacctgcacagcgtgtagatcagggacggttcctgcagactctagaggagacgggactggaacgcaaagagaggggctagaacctaggaggcgggttgcaacccgcggaggacgagattctcaggtgctgggggcagggttaggtcgggagttgagcaggattagaaccactgacagggcatagttaaagccagcagagaagggattagaatgtgggggttttgcttagaccttgagttgaggctgtattttgggagcatttttgataaaaagagactcctagggcaggctcagtggcttccgcctgcaatcccaacactttgggggtggaggctgcaggatcgcttgagcccaggagttccagaccagcttgggcaacatggcgaaacccccgtctctactcaaaatacaaaatac

SEQ ID NO: 19299 - DNA, 3572 bp, Homo sapiens
  ENST00000417954
agctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcaggccttaaggatgtcccggcccagactcggcctctgcctgcctggtcccttcccaccccagagtgcagccccagcaagagcaggtatggcggcctcctctgcagaggaccctggcagcgagaggggaccctggcggcgagcggggaccgtggcggcgagaggggaccctggcggcgagaggggaccgtggcggcgagaggggaccctggcggcgagaggggaccctggcggcgagaggggaccgtggtggcgagagggaaccctggcggcaaaaccgagaatgcagtgggtcactcgggccacggctccctgaggacaggaactggccccggccccacctcatcccacgctggagtcgtgcacagacgtccctcgggaggagtgaagaggccaccgggtctgcgtctcaggtaaaaaggtgactgaaaatgccccaccctgctgacatcagggagacaaagctcttggctcaaaagacagcagagtggacacctttgggctgagcgggagaacccccagcatggagggcttggagggcatggagggcatggagggcatagagggcatggagggcatggcccaggcccatggatgccctgctgagaatccacaggggcctgttgtatgtgtgtatatgggtgcacatgtgtgcatatatgtgtattggtgtgtatgcatgtgtatatgtatgtgtgcatgagtatacatgtgcagtgtgtatgcccatcatggaatgggccagggagggctcatagtcatgtatgtggatacacatgtggatacgtgcacatgtatgagtgtatgtatatacctgtatgggtgtgcacgtggacaggctcgtatatgcatgaatacatgtgtatatgtgcacctatgtggagtgtatgggcatgtgtacacacatgagcacgtgtggatgtgtgtgtgcgtgtatgtgtgcgcgtgtgtatgggcatgtatgtgcatagatgcatgtgtatatgtgcacacatgtatgagtacggccatatatgtgcatgcatgtttgggcacacgtgtgcgtgtgtggacatgtatgactgtgcatgggtatggcatgaccagtgctgtgtggccacatggcagggctgcttataagtggcctctgggaggagctgcaggaccccaggctgtggccaggccattcccaggtcctggtctcccagccacccagtccgccccttgagagacactcaccctcatgccaaatccaaggctggcatctcccggctcccctttctctcctttcaatccgttcatcccggggcgaccctggggcggagcacagggggtggggactgctgggcactgatgattaccagacaccttcccgcagggtgcctgccgttagccccacgccaggcccggccggcccacgctcagcctcacacgttcccagctctcaggctaccccggcccttctcacccctttcctgcacaaggacccttttgggaggaggtgactgagcctagcacacacaggcccactgccctgtctgcctccagggcttcctcctgggtactggcccctcgtggggtactgccagccacatccaggacaagagctgcgctcaggcagggccggttcttgggggaggacagtgggtgcggcggccgtccactcccctctgggcatgtcacccccgtgggcctgggctgctccccacctgccagaccccatctgccgcccccactggagaccccaggtcctcaccggccgtccaggaaagccaatctctcccttgtaccccggccgtccgtatggaccctgcaagaggaagggggccaggcttagtggggcagaccctggcccttgaccacgagttggggggtcctggggaaggggaggggccatgcagagcacagcaccctgggccacccatcagctcggaggagcccactgcagcctcacgccgacacctgccccacacgctttaaaactgcactagggagatgagccctgggccgcacagcacaagctcagcagccgcgggcgaccgtgtccttgggggccgtcatgcccgagctcagtgcagagaaagccagggaccgacttaccgggggtcctcggaagcccggctctccctgagcaaaaaaacaagaagacagggttaggtggcagcttgtgccccacctggcagcctctctgagggcccctgtggcgaaggcacggttaggtggcggcttgtgccccacctgatagcctccctaagggccgctgtggtccctttgggtgcactgggccgtccccaaggcgcaggcagccctggggaggacaggagccactggtgaggggagggtcgggtttggggtttgcgtccaggttggtgcgtgcatgcatgccccgggaccctgaagcaggggtggagggtggagggtggagggcatgtgccacgcagtgtcctggttgccacaggccccagctccaatgcacagctgggtgggatagtggagctctcactgggcctggggatcctgtgtctgaggcccaccccaaacaccccggagggctcactgctccctctgaaagtgggagagccggtggcccacactccaaagatccaggcttctccccaggaccctccccgagggcttttctgggcggctgcctgctgggggtggggacgcaggcacaggccccttgaggaactgactccgggccctgcccacagcatcagggcccccaggaagaggctggaggggcagccagaaacctgctgaggctgagctggtacagcctgggctcctgcaccccacaggccaggccccagggaggcgcgagctcagagctgcagcccactgagaacctcccctcagcagggtgggctcaggggtagggagaggacgaggggcagggagaggacgaggggccggcggaaccgccgacatgggtgcgagaaaggaggggccaccagggccaggcctggatggtagagccctgcttgggagaggctcgtgcatcaggagccagaccctcaggaagaccctccccaggctgtctccacagccccaggagcccccacgcctgccggaaggaggctgcccggccctcaccttg

SEQ ID NO: 19300 - DNA, 2029 bp, Homo sapiens
  ENST00000567670
actcctcgcagtcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcaggccttaaggatgtcccggcccagactcggcctctgcctgcctggtcccttcccaccccagagtgcagccccagcaagagcaggtatggcggcctcctctgcagaggaccctggcagcgagaggggaccctggcggcgagcggggaccgtggcggcgagaggggaccctggcggcgagaggggaccgtggcggcgagaggggaccctggcggcgagaggggaccctggcggcgagaggggaccgtggtggcgagagggaaccctggcggtgagaggggaccctggcggcgagaggggaccgtggcggcgagaggggaccctggtggtgaaaggcgcccgaggctagcctggctctctgggcttctgctctgccagcccccagacatcctcaaacagtggttttctcacatttt

SEQ ID NO: 19301 - DNA, 646 bp, Homo sapiens
  ENST00000461785
gggagcagccacccagcgggatgtacaggaccttgggggcccccaaccccacagggaggtcacccaccttcatttcagcctccaactgaagaaagtcaaacggaaactgccctgcaagagagagacaggcggggtctcgctgaggtggtgtctgacagcgccgggttccctctgcagcccccagcactggactcggtggtggtttttctagactgcccttccatctggtgacttcggtacattgacttactcatcctgagagttcacctgcagatccacttgtggggcttacgtgggagacgtgctgagaaaagagcaacgcgcttctttcctcccagcgtcctgcccttcccatctctcctctgcctcctcccagggtgggcaggcagctgtgtcttggccctgacttgagggtccctccaccctctccaagggtgaagctgtggcagttccaggtggctccttccagaccacggaggagccctttgctgaaatccctgcttgttgctgcttctctccttttcctcagtcccggcagaggtgcaggaatgttgttcgcctttgcaaagaattaactttggatttttggactttcttgatccttgctatttttatatataaaacatacgcaatttctcttcactca

SEQ ID NO: 19302 - DNA, 1435 bp, Homo sapiens
  ENST00000468508
cttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttgaacgaatgactcgggttgatgttgccggatctcaggggtggctgtgactgacagaggaccttgttgcacctcgtggctgctttgttcacccgcagggcggcctgtgggcaccccggggttccccttcagtcccaaggagggtaaggatatgggtttcctaggagacagccaatgactgccctgcatctggagccagcctgtccatgggcagtgcacagatgacagccctccctcactgccctgtgtgctggctaccgcatgtcctgtgccagcctcagcctctttgatgtggccgtgttccatcctggcgctcagctggacaagtgctggctgagccacgtcccagccaggggcatgagatgggggccctggatgggaggctgccagaccccaactcatgggtcccttgaatctcccagcttggactcggccagggtggagctgtctgctttggatgtatcatctcatggctcatttgggaggccagccccaggctgctgtgcttggtgttggaggacaggccggagctgggggtcacagtgcgcctctgagcttgggaacctgcttcagcctggggttgctgtggagaatggcccagagctgagcagaaggggctccccctagccccagggacctgagcctccctcccatctaccgcagggcgagcacacaccctggaggagcccagatggccttgtgctgagtgtggcctcagctcccattgcctcacggggcctgtctgctaacaggtctgggttttgtgcacagaacggtgctgctaggtgggagatgaagtcagcacctgctggggcgagcacggcttcccaaagcaggaaatcctggagaaatcgagccgtggtctgatcaggccaagaggttgcacagggcatgatactgcaccctgcctgacccagctgggctcacaggtcaggggagagttggggcaggtgaatgtcagcatcaggcttctgttttaaacttttaaaaaaatacactctttggcttccttttatttcttgaggattacatgaaacgtgaactatacaggaaagtatggcagccaggtcctggggccaggggctggccggccgctccctgcccacggtgggggcttcctccgagccgccggtcctctccggccatccgcatccaggcggtggctacttggaggcagtcatgaagctgttctcaatgcag

SEQ ID NO: 19303 - DNA, 600 bp, Homo sapiens
  ENST00000460174
cctgaggctgcagatgagacttgtccccagctggctgtccatcctcctggtgtcagcaagctgggtttgcagtgtcttccaagcgacggtgttcagaatgtgaaccagtgactctcgggcgcccctgtgaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttgaacgaatgactcgggttgatgttgccggatctcaggggtggctgtgactgacagaggaccttgttgcacctcgtggctgctttgttcacccgcagggcggcctgtgggcaccccggggttccccttcagtcccaaggaggggcgagcacacaccctggaggagcccagatggccttgtgctgagtgtggcctcagctcccattgcctcacgggg

SEQ ID NO: 19304 - DNA, 3811 bp, Homo sapiens
  ENST00000311124
agccgcgcgcccgccgcgccgccttgtgggcgctgtagtcccggagtccgcgtgcgcggggccgggtccgggagccccagggcagccgccccgccgagtcgcaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactc

SEQ ID NO: 19305 - DNA, 1884 bp, Homo sapiens
  ENST00000380010
agccgcgcgcccgccgcgccgccttgtgggcgctgtagtcccggagtccgcgtgcgcggggccgggtccgggagccccagggcagccgccccgccgagtcgcaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgag

SEQ ID NO: 19306 - DNA, 1896 bp, Homo sapiens
  ENST00000485649
ggccgttgaggaggtgcagggagaggagcgggagggctctgggtggctgccaagggggagctctgcgctcagaccctcaactaagaccaggaggtgcctgatgaggccccagcctgcagagccagctcctggtggaagaggaaatgaggcatgctccattcattcggaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtg

SEQ ID NO: 19307 - DNA, 648 bp, Homo sapiens
  ENST00000427839
gtggatccggcgttcgcgcccaggcacgtgttgcttcgggacgggccagccggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttct

SEQ ID NO: 19308 - DNA, 777 bp, Homo sapiens
  ENST00000443742
tcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggcta

SEQ ID NO: 19309 - DNA, 708 bp, Homo sapiens
  ENST00000486303
gaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggcgaggacagggtcttgccctggctccggctgtcggtggcggggctggggctggagcggcggagccatctccttgacccctcatgaaatgccttctgctcctggccagtccgtccctctccctgccacccactgaccagatggcatctctgctcttagtggagggccactgtccaccgccaaggttatttataggggtgagcattatgtgtggcgtttcccttaaaataacaaaataagaaaagtctctagagcaaaaatgtttaaatcccatctgcctgccctctcatgttgtacattaacggattaaaaagtagattccagaaattaagccattccaccaggccttggatatcatcagagggacgatgggtgcaggtgctctgcgcacctgccacttggtggggcccccgatctcagcccctctggctgcaggagaggcccggggagagcttcatcacgccctccctcctggggcccgacaagaacttcacgcgggagcaggcacgtgggcgccggggtgcaggggcagccaccagtaggtgg

SEQ ID NO: 19310 - DNA, 580 bp, Homo sapiens
  ENST00000528477
agtcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacagcagggccaggttctgcccacccgtggagaaggccagtacaggggagagagccagggctcccacaaagcagggggtccctccaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcg

SEQ ID NO: 19311 - DNA, 3671 bp, Homo sapiens
  ENST00000236137
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaa

SEQ ID NO: 19312 - DNA, 2976 bp, Homo sapiens
  ENST00000367804
gggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacttttcaaattgctgcaaacctcagcatggaacgctatgccctagtatttggtgtaaataccttcattgccctggcactgcagacgctgctcactctaattgtggtagatgccagtggccttggattagaaattaccactcagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtata

SEQ ID NO: 19313 - DNA, 3722 bp, Homo sapiens
  ENST00000262352
ggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggcattaccacaggagtcttggttcgagaacacagcaacctctcaactctagagaaattctactttgcttttcctggagaaattctaatgcggatgctgaaactcatcattttgccattaattatatccagcatgattacaggtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcaggaatatgttccctgagaatcttgtccaggcctgttttcagcagtacaaaactaagcgtgaagaagtgaagcctcccagcgatccagagatgaacatgacagaagagtccttcacagctgtcatgacaactgcaatttccaagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatgaaattgaatcagtaatttatcttgggctaaatggttctaccccttactaggttgccccaattagtggcactagttggcagagctgttcatgagctgccagttatcattttggagtcagtttgaaaccagcctcttaacacactgctgttaactcataaaagagaagagtgttccatttcagtctcaataaacacttccctcattctttc

SEQ ID NO: 19314 - DNA, 484 bp, Homo sapiens
  ENST00000490167
ctgaaacctccaatgacagcttgccgaaagatgattcagttgtttctcaacttggcccattccccacgtccaagtccaattggagaacggcttttgactccgtttatatgagcatctttgatagagagcaaaggtttctggcaaggcgggatgcctgccttccacctctaatccagctgtccttgacactccagacagccctttcaaatctgggcaacacttagtcatcttactggtagccaaggaccatttgaagtgagatctaacaatatgatcgtgttgctgcactggattccaacgtatccggaaaaattggtctgcgcgctgtcgtgtattatttctgtaccactctcattgctgttattctaggtattgtgctggtggtgagcatcaagcctggtgtcacccagaaagtgggtgaaattgcgaggacaggcagcacccctgaagtcagtacggtggatgccatgttagatctcatcag

SEQ ID NO: 19315 - DNA, 726 bp, Homo sapiens
  ENST00000422398
tttcttcaatgctttgagtgatgcaaccatgaaaatcgttcagatcatcatgtgttatatgccactaggtattttgttcctgattgctgggaagatcatagaagttgaagactgggaaatattccgcaagctgggcctttacatggccacagtcctgactgggcttgcaatccactccattgtaattctcccgctgatatatttcatagtcgtacgaaagaaccctttccgatttgccatgggaatggcccaggctctcctgacagctctcatgatctcttccagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcagggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttcta

SEQ ID NO: 19316 - DNA, 766 bp, Homo sapiens
  ENST00000493121
ccataccgcagacagctgcctggcgggcgacccagccccatcctgatggccccaggacacaagcccaggagcgccccggtgcgcgcggttccgcggcccaggggcgccgggtttggtggcacagcgagccccctttctctagcgaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggatggagtacagcggcgcgatctcggctccctgcaacctctaccttctgggttcaagtgattctcctgcctcagcctcccgagaagctgggattacaggcgtccgccaccatacccagctaattttttttttttttagtagagacggggtttcaccatgttggccaagctggtctcaaactcctgacctcaggtgatctacctgcctcagcctcccaaactgctggaattacaggtacgtacctgtgggcatcatgttccttgttggaagcaagatcgtggaaatgaaagacatcatcgtgctggtgaccagcctggggaaatacatcttcgcatctatattgggccat

SEQ ID NO: 19317 - DNA, 461 bp, Homo sapiens
  ENST00000471551
agctgcctggcgggcgacccagccccatcctgatggccccaggacacaagcccaggagcgccccggtgcgcgcggttccgcggcccaggggcgccgggtttggtggcacagcgagccccctttctctagcgaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtgctcagcgacccttccctctatgatgaagtgcattgaagagaacaatggtgtggacaa

SEQ ID NO: 19318 - DNA, 1217 bp, Homo sapiens
  ENST00000531327
agctgcctggcgggcgacccagccccatcctgatggccccaggacacaagcccaggagcgccccggtgcgcgcggttccgcggcccaggggcgccgggtttggtggcacagcgagccccctttctctagcgaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtgctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacacca

SEQ ID NO: 19319 - DNA, 4561 bp, Homo sapiens
  ENST00000234256
ctccagccggcggctgctccagggaggctgggcgcgatcctctccgcccgcggctccaacccgcactctgcgcctctcctcgcctttctcgcacctgctcctgcgccaggcccggagacccccggggcggcttcccagaacctgcggagcacaactggccgaccgacccattcattgggaaccccgtcttttgccagagcccacgtcccctgccacctctagctcggagcggcgtgtagcgccatggagaagagcaacgagaccaacggctaccttgacagcgctcaggcggggcctgcggccgggcccggagctccggggaccgcggcgggacgcgcacggcgttgcgcgggcttcctgcggcgccaagcgctggtgctgctcaccgtgtccggggtgctggcgggcgcgggcctgggcgcggcgttgcgcgggctcagcctgagccgcacgcaggtcacctacctggccttccccggcgagatgctgctccgcatgctgcgcatgatcatcctgccgctggtggtctgcagcctggtgtcgggcgccgcctcgctcgatgccagctgcctcgggcgtctgggcggcatcgctgtcgcctactttggcctcaccacactgagtgcctcggcgctcgccgtggccttggcgttcatcatcaagccaggatccggtgcgcagacccttcagtccagcgacctggggctggaggactcggggcctcctcctgtccccaaagagacggtggactctttcctcgacctggccagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactggaa

SEQ ID NO: 19320 - DNA, 5789 bp, Homo sapiens
  ENST00000480594
atacattgctgcataacaaactactacacatttaacagcttaaacagcttaaaatctcacatatttactatcctacagtctctctggggtcaggaatcttgggacagtttagttaggtcctctgcttcagagtctcttacaaggctgcaatcggaggtgttggtcagggctaggttcttacccacaggtccacctggggagagattcacctctgaggtcatgttgttgttggcagaattcagttccttgaagtttggactgggagcctcagttggctcttggctggagaccacctgcagtttctagtctcgtgggcctttctaacatagcagcttgcttcatcaaagtatgcaagcagaagacaataagaagagtcagctagcacaatggaagctacaaccttatgtaaccaaatcgtggatgtgacatcccatcacctttgctgcatttgttcattagaagcaagtcataggtccacccagactaaagggattacccaaaggtgtgaataccaggaggccatcttagactctgcctgccacagctgggttgcagccagacctgcctacctctgaaacccaatgcactgcaaatagttgcctggagatcctggtgagcaacccagcttcttacagaagtaagaattagtggataagtttgacacaaattgttaagaatgatccagagtcttttgctcttctagacttactcttcttgcaggaagtgagaacaaatggactgtcagctggaatagaatttcttgtatatcaagaccagcatcctacacagagccctcagtaaaactatttgcatgaacagattttgggctccatcagctcgattgccctacttttataacaaatgtttataatatccttaattctaagatgaaatccataaataaaatgtccctgcccacataatttcaaaatatcaatatgatgtaactgtaatatacaaaaggaaaataattataacaaaaacaatgtgtctcaatatatacatgctctaaaataaagtggttgaatgcttactcctgaactcagaatcactgctaatgaaatagttataaatgcagactgttacttgacactgggtgtggaattagggactcagattctacaatttgcactggtggtgtgattttccaggaagacaaataatatttggaaacattctgaacaaagcaaaacaaaaaccaccccataatttacaaggagttacacttctggaaaattcagcgtatgttcaaattgtgaaaaacagaaccttgttttggaattagtttagtcttgagtaattatagataaggtttttatctacacgtatgtcatgcaagacattggagggccttgagataattcattatacaggactctactgcatttaacaggacaaatgtgtgggacctggcatttctccctacacactccccccaattggggaatgcctcaattttgcaacaacaaaaacgcccttggatttcactagtgagcagtgacacttgacattgcaaaccactgcaatggtgcctaacctctaggtgagaggaaagcaatgcagttatagacttggttggacaccattaagttcagatatcaaggagtaccatgagagagatggaaatgaaaatcagtggcttcaaagtatctactgtggcccagcagcgcaggcacagttagggtgcttaaatcaagcaaaaggtgcagtgtcagctaggggtggagagagaacactgtgttagggttttagaagtggacatctcaaagcagatactttgcacactgaattttaagaatactgatgaagacaggtaccatggctcacgcctgtagtcccaacactttgggaggctgaggcaggaggatcacttgagcccaaaagttcaaggctgcagtgagctgcaatcacaccactgcactccagcctgggcaacagggacctcatctctaaaaaattgttttaaaagaatactgacagaatgctttcttttccaacagaaacctgtttccctccaatcttgtggttgcagctttccgtacgtatgcaaccgattataaagtcgtgacccagaacagcagctctggaaatgtaacccatgaaaagatccccataggcactgagatagaagggatgaacattttaggattggtcctgtttgctctggtgttaggagtggccttaaagaaactaggctccgaaggagaagacctcatccgtttcttcaattccctcaacgaggcgacgatggtgctggtgtcctggattatgtggtacgtacctgtgggcatcatgttccttgttggaagcaagatcgtggaaatgaaagacatcatcgtgctggtgaccagcctggggaaatacatcttcgcatctatattgggccatgttattcatggaggaattgttctgccacttatttattttgttttcacacgaaaaaacccattcagattcctcctgggcctcctcgccccatttgcgacagcatttgctacctgctccagctcagcgacccttccctctatgatgaagtgcattgaagagaacaatggtgtggacaagaggatcagcaggtttattctccccatcggggccaccgtgaacatggacggagcagccatcttccagtgtgtggccgcggtgttcattgcgcaactcaacaacgtagagctcaacgcaggacagattttcaccattctagtgactgccacagcgtccagtgttggagcagcaggcgtgccagctggaggggtcctcaccattgccattatcctggaggccattgggctgcctactcatgacctgcctctgatcctggctgtggactggattgtggaccggaccaccacggtggtgaatgtggaaggggatgccctgggtgcaggcattctccaccacctgaatcagaaggcaacaaagaaaggcgagcaggaacttgctgaggtgaaagtggaagccatccccaactgcaagtctgaggaggagacatcgcccctggtgacacaccagaaccccgctggccccgtggccagtgccccagaactggaatccaaggagtcggttctgtgatggggctgggctttgggcttgcctgccagcagtgatgtcccaccctgttcacccagccgccagtcatggacacagggcactgcccttgccaacttttaccctcccaagcaatgctttggcccagtcgctggcctgaggcttacctctcggcactggcattgggctccccagccggaactggttaccaaggacaaggacactctgacattcggcttgatccatgtccaggtgcaactgtgtgtacaccagggatctgtttggaaacaaccccttgagctgccaggctcaagaaatcatggactcacagggtcctgtgtggttacatcttggaaaaaatgcagatgtatttcactctccccggtcagctctgcatcaggtgttttctgagcaaaccaagggggtttatagtcatctgtcgcattgcctcgagttgcagtaattgaaaaaatgctcaaattcttagccatggctggcctttgctgagctgggactcaggtgtttaaagagtttgtgctatagctaggtgtggatagcttctgatccctgggttctgggagactgcaggtgccgcacattgtcaagttagaaatactccaggtgggtgttagcactgtggtggtctctggtccacagccttaggtaaacaacttagattctgaggtcaaagaaaaaaggagagggaatgcagccttgtgggggagaagcggggcagagggttctctaatctaatcaggacaggacaggtttcacatacaattgtcccagttcgcatcccagccctggggcacttttctgcttccttccagaggcctgggcctctgataacactttggctttttctccattcacgctgatttggcaaaaggccagagatgggcctccttccctggggaggtgtgatgtagttatcacattcaggacccttgttgatttatcatctattatttgaattcaactggacactctgtaaaatgctgcactgcagcaaaaacaaaaccaccaccaccccagagaaaaccatgtactaattggagtggggtacccccattcacaggttcccaggtcccctggctttggctgatttcaaaatatagagccctttcttgccagtacatccaagtttaaaattatcagcgaaatggtccatgtttttccaattacctgctgacacggttctaagctaagtgaaggggaagatctgagagcgtgctgtttgtggctgttgatgcatattcgtgatgtaacaggtcctggggcctcactttaccccatttgtaaaatggggctaatgtcacctgcctcttacctacctcagagggatttggtgaagcaaactgttaatcttcgaaaacgaccatttcacttcttggatatcaagtgctaacccagtatgttcttcttttttatgtaagggacagctttctccacagagtcctttctgctggtgaggacagcatttctgagcagggctttgttctctatgtgcattaggacttttatcatgcccttgttctgtgtgtagttacttgacagcatcaaatgccgcctcttcctaatgtccttcaagttttcatgaactagcaaccccaccttccaccatggttctgggcgcctgattttgctgtgactcccagacccagccactgtttctgccaccctgtaacaggccattaaagctccccagtgttcagcctccttcactcccttgttttccctgttgctatgtgtcacctgggccctacagacaggggcacacgcttatggatgtgtgtaccattgagatgagaatgggtagatggaacggagaccatcaagccacacccccttcttaaaactggggacatgagcctgagcagaaagggtgaagaagagccatgggacacagagttgacccagccagggggaaagcccagctctctttaaaccagctaagccattccagtctcctgtgaagccaaaagggaccaggaaccgtgcaaaggaaactggaaacttttccccgctgggtagagcatgttgctgatactcttctgttttcaagggaaacaatcacattgtttgattccaaatggtaaatgaacactcactattcttcaggcttcagtaaatctttttttcttccttcatatatatatacacaacacacacacacatatgtatatctatacacacatgtgtgttgtgtatatgcatgtgtgtgtgtgcgtgtgtgtatagttttagctccaagccaagcaagtttgtgtttggatagaggggaacttaactattaactacaagttgtatgtctgtggtatcttgattttcccatttctaaagatgaatttcacaaagccataaagcgtgaaattagagctggacttaagactcattggccgaccatcctgtgtcctggcctggccctgcagtaagaagcgtgtctgggtctggagaagggtgcttccgagagtgtgcaggtggcccttccccttggaggcgagaagagagaatgtgctgtctatcttcctggttttcagtccacagagtcggtagaccaggggttacgtgactggggaaaatctcacatctccttgtctgaaaacatttcccctgctgttctctttctaacatgttgtggtaaatctgttcagatactgctcatctgactgttttgtacatgtgacaattgccttaaaacctagcacagtcctcagaaatgaataccgtgtttccactgg

SEQ ID NO: 19321 - DNA, 1794 bp, Homo sapiens
  ENST00000430939
actggcatcctgactccttgagaaagagcccatctagcatccttctcgccgttgcttccagcaacatggcccttcttccagctttaggatgtcctaagcgcttccagctgtccaggtcacactctgtcgcatgtcgatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctgcccccccagagaggagggaagggggctggggaggggagtcctggtgacacatctgttgcccaactgaccgtgggctgaacacacgttctgcttgactcatttaggggggagggaaaagtgaaataaaggagcaggaatgaaaggt

SEQ ID NO: 19322 - DNA, 1719 bp, Homo sapiens
  ENST00000221742
gatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctg

SEQ ID NO: 19323 - DNA, 1735 bp, Homo sapiens
  ENST00000600144
agaagcagcattgtggtttcaggagatgggtccatttggagcaggatcctaagtggggcttggcattgggaatttggattagctctagaggacgcaggatctggaaaatcagggcagatttcccatcccttggatatggtggggagttgaggagggcaaggaagatcccagaaaagccagtggcagcaaaacacaaaggccagggacctacgtactggtaaaactgagacctccaagaaacctgcagctcgacctggttgaattcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctgctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtga

SEQ ID NO: 19324 - DNA, 2987 bp, Homo sapiens
  ENST00000598504
gcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgggatgtaagaggctccgagaagcagcccacacatctcatcagatctaagtgtctagaggtcgggagaaccaagtgggaaagacccaccctcacccctcaccctgtagaaactgggaacactagaagggacattttctgagcaggaaacccaagagacagggttttacgctgtcacccaagttggagtgcagtggtacgatcatagctcattgcagcctcaaactcctgggttcaagcgatcctcctgctttagcctcttgagtggctaggactacaggcacaggccaccgtgcctggctaatttttaatttttaaaaaagagacagggtctggctatgttgcccaggctggccatgaactcctgggctcaagcggttctccagccttcacctcccaaagtgttgggattgcaggcatgagccactgcgtctggcccacagatgctaagtgctgtctgctcttctccaggggtcagcaaattttttcagcaaatggcccaagagtaaacattttgagctttgtggcccgtacaatctctgtcccaacaactcaactcaggcattgtagcttgaaagcagctgtagacaataggtaatgcatgagtgtggctgtgtgccaataaaactttatttacaaaaacaagcagtaggctgaatttgactagcagaccatagtttgtcaataccgtattatgtcttgtaaggaagagaaaggaaccggacaaaactctagcctcgggagttttcctgactgttcagatcttagctgaatgatctcccttggtatctacaggcaacttcctgctgtggcttagggactggaaacataatatcccagagggattccctgtgtagtctgtggttcactctttgggattttttttttttttttttttcacagcaaggagaagcagcattgtggtttcaggagatgggtccatttggagcaggatcctaagtggggcttggcattgggaatttggattagctctagaggacgcaggatctggaaaatcagggcagatttcccatcccttggatatggtggggagttgaggagggcaaggaagatcccagaaaagccagtggcagcaaaacacaaaggccagggacctacgtactggtaaaactgagacctccaagaaacctgcagctcgacctggttgaattcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtgagtcctggtctgtgcccacgggatggtggagccagagctgggaagtcaggctgtggggaagctgccgaagggcttgctggggacttttggtcattcatttacgtattgggtgattcacttacccactcaccaactcattcattcatgtctttctgggatgatttcatcactagttgacttccttgttcatctgttcattcattcattcttctatgcattggttagttcatggaatatctcactctttcattcattcatgtccttctgcaatgattcattcactgctttgttcatctgttcattcactcattcttctatgcattgatgaaatcactcattcagtgatttattcatctatactcatgcttcaatgcattgatttactcatttcctcatgcatttattcattcatctatgcattggttaaatcactggccaactcactaactcattcattcattcacacttttctgcaatgatttgttcacttgttcactcccttgcttatctgttcattcactcattcttcaatacattgaccaagccattcactgacatttattcagctacatttattctttcatgcattggtttctggatttatttggtcattcatttatttattttgcaaaattaatgtatttttaattgacaaataaaaactgtatatattttcatgtgcaacataa

SEQ ID NO: 19325 - DNA, 2420 bp, Homo sapiens
  ENST00000544886
cttcgcgctggcacggagcatttccagcctcacgcgctttaattttctcagctttaattttctgtggggtcggccaagccatcttccttgtttagcggaggaagccaggctcagagagggagaggagttggcccaagggcacacagcagccaagtggccaaggccggaaggtgcacccgcaaggagaagggggcagcggagccctctccctggctgttgttactgggacactagagccgcgccttccccaggcctccgccgaggctgctggagcgggtcccgcggtgccagggcctgttccccgcgctccgccagggatgctggggcctccgagggctccggaggcggtttagggggcgggggcgcggaggcgcggctccgagcagggggcgggggctggatgccggagaggccactcacccccgcccacccccagtccccctcccttcgcaagcacgctgtcccccttctcccacacggctgcggagcctgggctgggcgcgggggaggcggagggcatcgcggaggggatcccgccccctcccccggccgctcggtgcccccacacccacgtgagcgcagggccggcccggatccctcccgcagcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtgagtcctggtctgtgcccacgggatggtggagccagagctgggaagtcaggctgtggggaagctgccgaagggcttgctggggacttttggtcattcatttacgtattgggtgattcacttacccactcaccaactcattcattcatgtctttctgggatgatttcatcactagttgacttccttgttcatctgttcattcattcattcttctatgcattggttagttcatggaatatctcactctttcattcattcatgtccttctgcaatgattcattcactgctttgttcatctgttcattcactcattcttctatgcattgatgaaatcactcattcagtgatttattcatctatactcatgcttcaatgcattgatttactcatttcctcatgcatttattcattcatctatgcattggttaaatcactggccaactcactaactcattcattcattcacacttttctgcaatgatttgttcacttgttcactcccttgcttatctgttcattcactcattcttcaatacattgaccaagccattcactgacatttattcagctacatttattctttcatgcattggtttctggatttatttggtcattcatttatttattttgcaaaattaatgtatttttaattgacaaataaaaactgtatatattttcatgtgcaacataa

SEQ ID NO: 19326 - DNA, 3264 bp, Homo sapiens
  ENST00000596697
aatatagaataaatgatcattaaccatagtccctctacggtgctgcagaacaccagaactcattctttctatctagctgtagttttgtatctgttaaccaacctctccccatcctctcctcccgcctacccttcccagcctctaatacaattctactatttccctgatgttttcatctctttcaaaatcagaagacagaaacaagcatttaggtgaaagaatgttataatgtagaatattaacatattcattttaatttttaatttttttagggtgggtgcggtgtctcatgcctacaatcccagcacttttggaggctgaggtgggaggatcacttgagcccaggagttggaggctgcagtgagctgcactcctgcctggttgacagagcgacattctgtctcaggtcttgaactcctgggctcaggtgatcctccccactcagccacccaagtagctgggattacaggcatgagccacagcagctggctcaatttttaaaattgaggggaattcacataacacaaaagcaaccatttgaaaacatataattcaatagcatctagtattttcattatgttgtgcaataattgtcacctctatctcgttctgaaataacatatttttctttatatgaatgcagttgtgaaatagaattttaatgtaggcttttttttaatgaaggaaggggtgcacaaagagaaaagttcctcaggcccatgaaaatcacaatttctgagccgccctgtacacgtgaggtgtttagttggtagacagatgggcaagttttaatttttatatgcattttatttaatgttgatgaaaaatataattcacatttcaagtaggggtctaaagtttccattttagatacatttttaattttaattttaaaagtatttatttatttttattttgagacagagtctcactctgtcgtccaggctggagtgctgtggtgcgatctcggttcactgcaacctccacctcctggattcaagtgattctcttgcctcagcctcccgagtagttgggactacaggcacctgccaccacgcctgggtaatttttgtatttttagtagaggcggtgtttcactgtgttggccaggctggtctcgaactcctgagctcaagtgatctgcccgcttcggcctcccaaagtgctgggattataggcgtgagccaccacgcctggttcggtactgttttttaggtaagtgaataaggacacatggatatggccaaatataaagaggagacgcaaaagcctgcagtttgggaaacatcagtacagtgcctgccaccccagaggggctcatgaacatcacactgtggccaagaatcattatcatttcattcccaagggactccccgctctcctgactccccgctctccctgttgctcacctgggcattcaggcagaatagctgcatttactgggcacctgctgtttgccaggcacctgctgattttgtccttgtgaaaagcctccaggctggacacaaaaccgtcctaatttgggggactagcctccgggtgctttgtctagggctccgtatgcagctggcacttcacaaaggcttgttaatttcccttgagccactggggcagcccccagaggcttgtgatgatctcagtgaaataagagtgggctggagtcagggtgtgtcaaaaaggtccattatttttgtggtttcctcctcttcccagccattctcaggaatgattctggagacttgacgttttcctgccaagacctgtccttagaaccgggcacatcgcaacagacttaccttccccctcccctgccattttgtttttagttatatttttatttacttgttgttcttagagacagggctgtgctctgtcactcaggctggagtgcagtggtgcagtcacagctcactgcagcctcaaacttctgggctcaagcgatcctcttgccttggccttagaaagtgttgggattacaggtgtgggccactgcgcctggcctttgtgcttttttggaggggtggaggtctcactatcttgctcaggctgggaagatcatagatcactgtaaccttgaactcttgggctcaagtgatcctcctgcctcagcctcccaaatatttaggactaccacccctagctgcccaggccagtcttgaactcctgggcgcaagtgattctcctgcctctgcctcccaaagtgctgggattacaggcgtgagccaaaacacccagccacccccgccttctgagagtcctcaggaagcgctcattacccttcgcagccttcgccatctgcccacgccggccttctgtcctggccctcaccagccccaggcttctctgtttcccgcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacaggtcagggggaagtacacagtttgatcaaggagattcggagggtggtgggagcttggggctgaagggatggtccaagggcaagaggcgggaggaagggcctgacagagcaatgggcaggggttcttgaggagtctaggagaaaggatgtattttccatggtgatctgggggggttagggagaagcacttaggtccgagaatggtggatcaggcttgtaatcccagcacttagggaggccaaggtgggaggatcacttgaggccaaaagttcaagaccagcctgggcaacagaatgagactctctgtctttc

SEQ ID NO: 19327 - DNA, 695 bp, Homo sapiens
  ENST00000597262
gcgcagggccggcccggatccctcccgcagcatagcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaagga

SEQ ID NO: 19328 - DNA, 592 bp, Homo sapiens
  ENST00000599636
gctttggaacttggcctaagtgcactggcatcctgactccttgagaaagagcccatctagcatccttctcgccgttgcttccagcaacatggcccttcttccagctttaggatgtcctaagcgcttccagctgtccaggtcacactctgtcgcatgtcgatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcg

SEQ ID NO: 19329 - DNA, 424 bp, Homo sapiens
  ENST00000595863
gtccacctcatgcccgatgttcttgcagttgaggccccagctgaggttcttgtgcgtggcgagcagctcgtccaggttcttttccagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctcc

SEQ ID NO: 19330 - DNA, 566 bp, Homo sapiens
  ENST00000601761
acattttctgagcaggaaacccaagagacagggttttacgctgtcacccaagttggagtgcagtgcaaggagaagcagcattgtggtttcaggagatgggtccatttggagcaggatcctaagtggggcttggcattgggaatttggattagctctagaggacgcaggatctggaaaatcagggcagatttcccatcccttggatatggtggggagttgaggagggcaaggaagatcccagaaaagccagtggcagcaaaacacaaaggccagggacctacgtactggtaaaactgagacctccaagaaacctgcagctcgacctggttgaattcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggtgagctctgcctcttg

SEQ ID NO: 19331 - DNA, 493 bp, Homo sapiens
  ENST00000594383
gcgcgtcccggctccgcgccggtgcctccacggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccggtgagtggggactccgcggctcggcgcggggactcggtgtggctgcggcgcggaggttgcgggcaggtgggggatccgaggcgctggggtcaggcgtgtggggcgctccctgcgcccacgtccccacttctccgccgccctttgtctctgagctcctgcttgccccttagagccgttgccaccgcttttctcctggtcgttctgatagaccatgagcagccatggcaacagcctgttcctgcgggagagcggccagcggctgggccgggtgggctggctgcagcggctgcaggaaagcctgcagcagagagcactgc

SEQ ID NO: 19332 - DNA, 3381 bp, Homo sapiens
  ENST00000272542
gcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgtcgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatt

SEQ ID NO: 19333 - DNA, 668 bp, Homo sapiens
  ENST00000423633
ctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgtggctgaaatctcctagaaggtggctggcctgcgcccatttcagaaggctgcaggctagtgtacgctgagttaacctagatagtttttcaaccaaagagacctgctcagattctaaatcactacagacctttcctctttagtcttcacaggatccactgataatatgatcatctccttccctttctcctgtctatgctaaaaatgctggaattaatactgacctcaactactgaagtcattagttatatctgatcttcagtaatcagtcatttaggactggtttgctggatattctcatttttctctcccaaatggagatactattgtttctaagtactaaacttccatgaatctgcttgaatgagaagagttgggatgtttaccacctgctctaagtgcacttggaagaagaaattcatgcagctaagaggaaaaataatttgtgagaatataaaggttgaaatgtt

SEQ ID NO: 19334 - DNA, 692 bp, Homo sapiens
  ENST00000498224
gatattttttcttaatgtgttctattccagtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcac

SEQ ID NO: 19335 - DNA, 638 bp, Homo sapiens
  ENST00000433924
tttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctc

SEQ ID NO: 19336 - DNA, 574 bp, Homo sapiens
  ENST00000456264
tattcttcctggttcgtgcattcatcctccataaggcagatccagttcctaatggtttgcgagctttgccagttttctatgcctgcacagttggaataaacctcttttccatcatgtatactggagcaccgtggctgaaatctcctagaaggtggctggcctgcgcccatttcagaaggctgcaggctagttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcacc

SEQ ID NO: 19337 - DNA, 584 bp, Homo sapiens
  ENST00000413135
cgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaa

SEQ ID NO: 19338 - DNA, 738 bp, Homo sapiens
  ENST00000480984
ttatgtcatgcttattccttgaccctccccacccaaatggtgcccccccttccatcactctcctcttacccttctttatttctcttcacagcatttgtcagtactttacattattccatactagaaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagct

SEQ ID NO: 19339 - DNA, 613 bp, Homo sapiens
  ENST00000492076
agtctgcatgttgtatttttagtctttgaagatatgaagtcaggtaagcaacatcctaacatagtctatttcttgacatctcttacaaacgtagagtatagcctatcctcaggtgtgtgctgaagtttatattagggcttttgggtaccttagaatgtgggtattgcaatctttattcaggatgttatcagtcactggtacagttagtcttgttattaaaagaaaaaagaaaaaaaaacaggtagaagttggaattagccttcgtaggaagaattccagatgcaaatgcaggaaaaactctgttgtccttggaaactactctggagagagttattggcactataattcccaaacctaccctgttaaaagattctgtggaaatgggttaacctttataccttttaagatattgatcttaatgatgttttacaggcagatccagttcctaatggtttgcgagctttgccagttttctatgcctgcacagttggaataaacctcttttccatcatgtatactggagcaccgtggctgaaatctcctagaaggtggctggcctgcgcccatttcagaaggctgcaggctagtgtacgctgagttaacctagatagtt

SEQ ID NO: 19340 - DNA, 3202 bp, Homo sapiens
  ENST00000490674
cactttgcttgaattggtggactgaaatttgagagaatcctcttttgaaaagaatagaattgggtacagttcagatttttagtttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgctggttgttcccaagtgagagttgctggcaaatgataaagcaggcaggaaaaatgttcctgaatgttaattgaagttcacatacattcttgttttgagatgagttttttgggggtggaggaaaggagacgtggaacaaagtagtatggccacaaccaaaccaaaaaagaccccccttttttttcctaggagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgagttggaattcctggtttcacttttgttacctgcagtggtgaggaggcttattgttttggatttgatgctttttgtattgaatgtcaccttggtgatcttgactaggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcattgttctttttagattttacttgtctggcccttaaacattttggtcagacattttacccatttagctctggtggtctctgaagaaaatgacttttctgagaaagctgtgtatgctaagagcggatagttatgtatacttgccttttatttgtcttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatcttaggggttatagcaaataaagatgtcagtggaggttttgtgactgagtagaacaaagcaggactgtgttaacttgaggtgtagtgttagcttctcaaaaaagtcaaactcacttcctgacaagaatccttttgtgtctgtagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaa

SEQ ID NO: 19341 - DNA, 4720 bp, Homo sapiens
  ENST00000369503
gccgccagcgcttccatccccgccccggcgggtccaagccggtgccgggcgcccaggggttgccgcgctgggcgggagggcagcgcctgagagggcggtggggtggcggggttcctgcgcgcggcccgccatggaggtggaggaggcgttccaggcggtgggggagatgggcatctaccagatgtacttgtgcttcctgctggccgtgctgctgcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggagtggtttttaattgccaacagatcctacaaagtcagtgcagcaagctcttttttcttcagtggtgtatttgttggagttatctcttttggtcagctttcagatcgcttcggaaggaaaaaagtctatctcacaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggatcgattggcggcctgttctttgcagttggcattgcccaatatgccctgttaggatacttcatccgctcctggaggaccctagccattctggttaacctgcagggaacggtggtctttctcttatctttattcattcctgaatcacctcgttggttatactcccagggtcgactgagtgaggctgaagaggcgctgtacctcattgccaagaggaaccgcaaactcaagtgcacgttctcactaacacacccagccaacaggagctgcagggagactggaagtttcctggatctctttcgttaccgggtcctgttaggacacactttgatcctgatgttcatctggtttgtgtgcagcttggtgtattatggcctaactctgagtgcgggtgatctaggtggaagtatttatgccaacctggccctgtctggcctcatagagattccatcttaccctctctgtatctacttgattaaccaaaaatggtttggtcggaagcgaacattatcagcatttctgtgcctaggaggactggcttgtcttattgtaatgtttcttccagaaaagaaagacacaggtgtgtttgcagtggtgaacagccattccttgtccttgctggggaagctgaccatcagtgctgcctttaacattgtttatatctacacctctgagctttaccctacagtcatcaggaatgttgggcttggaacttgttccatgttctcccgagttggtgggattattgctcccttcatcccctcactgaaatatgtgcaatggtctttaccattcattgtcttcggagccacgggtctgacctccggcctcctgagtttgttattgccggagacccttaacagtccgctgctagaaacattctccgaccttcaggtgtattcgtatcgcaggctgggagaagaagcattatctttacaggctttggacccccaacagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtaaaatttctcaccattttggtggggtaagataagctattattaagatttaatccttataccatgttggacatttgcccctatcagttgctcctcaggaatcttctggtacaggttaacatcagcattttcattttgtgtccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatataccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggaaaaaaaaggtgcagtttttaataagagagaaaatgaaattatctttgataaatttttgtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattataagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcctctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttcattgacaggtaatgtattttggttgtgcggatggtttgtaaaaagtatcctgtttttttaattctattcaaaattaaaaattttttttcctaaaataaagcaagaaaaataaatgtaagatatataagaaaccccagagtttccagggtgaaagttcacattagcagcttgtccaaaatatttacacctcacaaatattttgaaagaaaccatgttgaaattttctgattttgtgagttacaaccacagcccagtaaaaccaatacttgttatttggctactttcaagcaatgcagatattctttagtatttaaaaatgagcaaataaacaaaatgaggcaaataaatgaagaaaatgagtttctgagacactgtttaggtaaccataaatcagacagatatttttatggtgggcaaattgatgaagatacttttagtaggtgatttatattcataacaaatacatattgaaataattgtcactactgtatcagaattaaaaaccagcttcacattaggacttctccatacaaatgctttatcattggttcttaaattggaaaaatatctataaatgattacatttttaagctaaataaaatgcagatattttggcttcttgtgaatgtaataaagaatcataaaacata

SEQ ID NO: 19342 - DNA, 1230 bp, Homo sapiens
  ENST00000369502
gcgcgcggcccgccatggaggtggaggaggcgttccaggcggtgggggagatgggcatctaccagatgtacttgtgcttcctgctggccgtgctgctgcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggagtggtttttaattgccaacagatcctacaaagtcagtgcagcaagctcttttttcttcagtggtgtatttgttggagttatctcttttggtcagctttcagatcgcttcggaaggaaaaaagtctatctcacaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggatcgattggcggcctgttctttgcagttggcattgcccaatatgccctgttaggatacttcatccgctcctggaggaccctagccattctggttaacctgcagggaacggtggtctttctcttatctttggtcgactgagtgaggctgaagaggcgctgtacctcattgccaagaggaaccgcaaactcaagtgcacgttctcactaacacacccagccaacaggagctgcagggagactggaagtttcctggatctctttcgttaccgggtcctgttaggacacactttgatcctgatgttcatctggtaattatactaaggcgtgttctgttgctctttaactaaggttgctcgagcttctcttgatatcctgctccttcttcagggtacagggaattttacctcttttgttagcttgaggttgttttctcaacagcaagtctcctgatccttagcgcctggttttctgcttgcgcagccccgtctttctcaagtagcagatgatagtgcctgatgggcaggtccactgagcttgagtaagtagacatcagaagcacatctttgcttttgaggtatttatcataaatatttaagccttcctgccccttcccctgc

SEQ ID NO: 19343 - DNA, 490 bp, Homo sapiens
  ENST00000481127
gcataataaatgttgaggcttggaggcatggagattaagaaaaccgttgaaagccaaacctgacaacacaacataggagctgctaatttgaggttctacccattcaaaagcaaatacttacaaagtttgtgtgcagcttggtgtattatggcctaactctgagtgcgggtgatctaggtggaagtatttatgccaacctggccctgtctggcctcatagagattccatcttaccctctctgtatctacttgattaaccaaaaatggtttggtcggaagcgaacattatcagcatttctgtgcctaggaggactggcttgtcttattgtaatgtttcttccagaaaagaaaggtatgcctttcaaatttctacaagggttttgaacagtactttcattacaatgaatcataatatagtggagagatgaccatatggcatgcttcatttctgtgattgcatattgtttagcaattgtgtgggatataatggg

SEQ ID NO: 19344 - DNA, 6641 bp, Homo sapiens
  ENST00000436008
ggaggcgcccgaagtcggagaaatacagcgcggccaccccgggagcagcagcctttgcccgcaccgccgcccgcagggccctgaaccgccggcaagggcgcgggccgggcgcggcgccggctcctcctcctgccgcgtccggcgcggagcagcggagagcggcgggctcggcagccggcgcccgggccgcggaactgatgagccgcggcggctgagggcccggccggcctctgcccgcctctgcccggcgcccgagcggggccgcagcgcccggggcgcggggtccggcgggtgacatgggggcggcctgacgcacccggagccgccgagcgctctctctcgagccgcgggccctcctcggcggcagcggctgcaggcgcctggcccggcgcgctgtgcccggggcgcccgcggagcctccgccgcgctctatgcgcctctgcgggagccgcgggcccgggccatggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagaactgcagctgaagttggccgtagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctcgggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattatgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgatacgcatctgggcccgccgggctcagcaggggaggctgctacggctgcccacttcccagcaccgtctgtcacgcttgaacccctctgtgctgttcccttcctggctaatagggagacccttcgcaggcacccactgtttcaacttgaccctcccaccccctgctactctcctccacacacccctccgttccgctagcctaccctgtcagcctttcaataaaagttatgcacaaatgtgaacacctgagatggagctgaacatttcttcactttgttctttttctgaagtcaaactcttatcaaatgccctaaaattattaccacccaagagaaacaggaaaaaggttacatgtttttgtttactgagagtaagatcacctgcatctggaagacgggctggtaaattggtttggctacagaacagaaagaaaacaaaaacaaacctcgtaagggaagtatcacactcagacaccaccgcttcctagagccaaatgagcaatcccaaactgcaagtgccataagtgggcctgtgaggtcacaccgcccggcccgaggtatcgcatgtgcgggggaggtccacactacagctgtcctctcgtctagaaggcaccacctcgctttcatgtcccgtgtgttttggaaaagcagtatggtgtgtcatgtctagcggcgaacacttccctccctgtccttgaggttgtaatataaaaactgtgtttctgtacgtgtgggtgggaattctctgacggtgctcgttcatagcacaagcttacgctgagttctgaactgtcgttcacagctgcgtgtctgcatggtgtcgcatctgttgtacctttggggaaaatttgtatgtaaatgtacagaaataaaaacgttgccccattaacagatttcctctggaatgtcttccctacctcacctgatggtatccaccgaagggcatttcactaccattaatggtgagtaataaaatcctccgtgttcattcagacctcactgcgtcactactttgaacgcctctgtaagctgtgtcttcactcgccccgaggtgggtggagggaggcctctcactctgcttcgagtcctggtcttaaaggtagtcagaggcagaggctggattaaacacacactgtttaccaagtgccactctcagaccacctgagagacgggggccatcagtaaaattaagaggaatttttttcccttgttcgtgtatgttctgctgatccgtggcctgaaggttcctagagacgtcaagaaatgaatatcttacactgtgattctgtgaggaaagactggtaacccaaaactctcttctctaatgtattttttaacgaaaatgacaatatttctttaataaagtatttataccaaactcttctctcc

SEQ ID NO: 19345 - DNA, 5658 bp, Homo sapiens
  ENST00000406686
atggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctcgggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattatgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgatacgcatctgggcccgccgggctcagcaggggaggctgctacggctgcccacttcccagcaccgtctgtcacgcttgaacccctctgtgctgttcccttcctggctaatagggagacccttcgcaggcacccactgtttcaacttgaccctcccaccccctgctactctcctccacacacccctccgttccgctagcctaccctgtcagcctttcaataaaagttatgcacaaatgtgaacacctgagatggagctgaacatttcttcactttgttctttttctgaagtcaaactcttatcaaatgccctaaaattattaccacccaagagaaacaggaaaaaggttacatgtttttgtttactgagagtaagatcacctgcatctggaagacgggctggtaaattggtttggctacagaacagaaagaaaacaaaaacaaacctcgtaagggaagtatcacactcagacaccaccgcttcctagagccaaatgagcaatcccaaactgcaagtgccataagtgggcctgtgaggtcacaccgcccggcccgaggtatcgcatgtgcgggggaggtccacactacagctgtcctctcgtctagaaggcaccacctcgctttcatgtcccgtgtgttttggaaaagcagtatggtgtgtcatgtctagcggcgaacacttccctccctgtccttgaggttgtaatataaaaactgtgtttctgtacgtgtgggtgggaattctctgacggtgctcgttcatagcacaagcttacgctgagttctgaactgtcgttcacagctgcgtgtctgcatggtgtcgcatctgttgtacctttggggaaaatttgtatgtaaatgtacagaaataaaaacgttgccccattaacaga

SEQ ID NO: 19346 - DNA, 2555 bp, Homo sapiens
  ENST00000497691
cttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtattacctgtggctgctttctggctattcacagagttgagtggatgcagcaggatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcacccc

SEQ ID NO: 19347 - DNA, 2883 bp, Homo sapiens
  ENST00000380302
aaacagcccccaccctggaagcctcaggtgccttccttcctccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcacccc

SEQ ID NO: 19348 - DNA, 2043 bp, Homo sapiens
  ENST00000490273
gccttccttcctccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccaggcttcttcaaagtctcacagccagcctaccctcaaagcctgagtgattgtggaaggagccagcgttcactcagcagaggaacagagctttcctgccgcaggctctcagtgaagatccagggagcagaggcgtgggcaaggagcactgggctcagatgcaggagaaccggtttgaaccctagcactaccgcctctacactgaggaaccttggggattactcagccccctggaacctaatttccaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatctttgcctgctgcacgctcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaa

SEQ ID NO: 19349 - DNA, 622 bp, Homo sapiens
  ENST00000482874
gcttggtccccagagggaattgcatacccatccatgccgcaagctggacactgggaaggagctgtgctgtgcagccccaggcctccctcccaccctggcctggcttcctctcttccctcaccaccttcttctgaccttcccccagggatgagtgacagcgtcaaggacaaattttccatcgcgttttccatcgtgggcatgtttgcctcccatgcggtggggagcctcagcgtgttcttctgtgcggagatcaccccgacggtgataagatgcagaccgaggcttcgggaagtgaagctggtgggcgggggccaggattctagcccaggctcatgggctccagaactcctgctcccagccacggcactcgcacctttgtggcagcaaaagtctgttctgtagctcactttgggctggctctttttatgtgggtttactcaaggcttggaggctaatggctgatgccccagtcttgacaatcatctaatggaataaacattaacgaagaccctgtaccagaaggcatctccttcctcgagaaatgcacagacggcgccctacccaggtgtggcgggctggggctggtgctggccagcgcgggcttcggcatgctgacggcacc

SEQ ID NO: 19350 - DNA, 1574 bp, Homo sapiens
  ENST00000485307
aacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgcgtcatgggagacaccccaggggacgccggcttctcggaaatcaaagacgagtccctggctccaggctggtgtgggattaaccagcgtcagctctgtctctggctctggacacatcagcttcgtggttcatagctgaggtggctgttggacccaaccccgaggcgcccaagaggcagtgagaacctggccctggggtcctgtccaggcagcagcaggaggaagggggaacagggagctactctgggcccaggaaatatgtcagtgtctgagcgtctggcaagggggggagtgcagcggatcacttatgccgcacttccaccagaacctgtgctgccaactctgctaagagacctcacggcacagctagtgcaaaatgtttcaca

SEQ ID NO: 19351 - DNA, 1221 bp, Homo sapiens
  ENST00000467177
atcttcgtccagggccgcagtggctccggtgcacttagagtcaccctggggaactttcagaaatgcctgtaggaccccagcatccatcgtttaaaagaagttctctggacactttccacgggtgttgtcagcagcaggaaactggagctctcccgtgggacacagacaccaagcgctggaggccggagctgaactgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccagcatcgcgctggtgtcctgcctggccatgtgcgtggtggtccgattcctcgggcgcaggggagggctgctgctcttcatgatcctcaccgccctggcctcactcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcgg

SEQ ID NO: 19352 - DNA, 542 bp, Homo sapiens
  ENST00000467144
gttggagcctcaacgcgcccgtaaaacactggcacaccacatagggcacttgtggtgggcagcagatgaaaacaatttcagtcgttggaatagagctgtgcccccctggaaaacggttcatgattacgatggtggcgagcttcgtggccatggcgggccagttcctcatgcctgggctagccgccctgtgccgggattggcaggatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaactcgctgacggggtacgggatccaccactgctttgccaggagcatgatgggccacgaggtgaaggtgccgctcctggagaacttctatgctgactactataccacggccag

SEQ ID NO: 19353 - DNA, 561 bp, Homo sapiens
  ENST00000496753
aattgctcccaggagctgtgaaacagcaacatcctcaggctggcagaactgctgatacctcaagtgccctgttgttcttttggtggctgctgggcagtggaaggggcacgatcccctctgcagcggctgttctctggaggagctgagactgcctgtatgaggtgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgatattccccgagtccctccggtggctaatggccacccagcagtttgagtctgcaaagaggctgatcctccacttcacacagaagaatcgcatgaaccctgagggcgacatcaagggtgtgataccagagctggagaaagagctttcccggaggcccaagaaggtctgcatcgtgaaggtggtggggacacggaacctgtggaagaacattgtggtcctgtgtgtgaac

SEQ ID NO: 19354 - DNA, 730 bp, Homo sapiens
  ENST00000433689
ccgtaaaacactggcacaccacatagggcacttgtggtgggcagcagatgaaaacaatttcagtcgttggaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtgagtacactctgcacagcgccctgggctggtgcgactgcacatgcttcctgaaggcccggccccgggcaggacacacaatccccacacttcccactagttgcagcttgtggttctgtctgagaaggttttcctctctttttaaaaaattttattgtttaaactttctgtcttggaaaactgttcaaatatacacaaaaatagaagagtggaatgagcccatcacccagctccaaaaatctgcaaatgcactggccagtctggctcaccccttcttgctacccaccccacggggttattctgacatgaatttttatgaatggattgcagggaggtggaggtcttgtgttaggaggggggatttggagatattaaaggagtgatttacaaaagtccccctatctcttctaggcgaggggtgggcaaccttcagcctgtgggccacatcaggcccactgtctgtttttgtaaataaagttttattggaacaca

SEQ ID NO: 19355 - DNA, 1574 bp, Homo sapiens
  ENST00000380298
atggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgaatagagctgtgcccccctggaaaacggttcatgattacgatggtggcgagcttcgtggccatggcgggccagttcctcatgcctgggctagccgccctgtgccgggattggcaggtgctgcaggccctcatcatctgccccttcctgctcatgctgctctactggtcgtgagtacactctgcacagcgccctgggctggtgcgactgcacatgcttcctgaaggcccggccccgggcaggacacacaatccccacacttcccactagttgcagcttgtggttctgtctgagaaggttttcctctctttttaaaaaattttattgtttaaactttctgtcttggaaaactgttcaaatatacacaaaaatagaagagtggaatgagcccatcacccagctccaaaaatctgcaaatgcactggccagtctggctcaccccttcttgctacccaccccacggggttattctgacatgaatttttatgaatggattgcagggaggtggaggtcttgtgttaggaggggggatttggagatattaaaggagtgatttacaaaagtccccctatctcttctaggcgaggggtgggcaaccttcagcctgtgggccacatcaggcccactgtctgtttttgtaaataaagttttattggaacaca

SEQ ID NO: 19356 - DNA, 2201 bp, Homo sapiens
  ENST00000200652
cgccttcagcctgtttcccaggaacggtccccggcttcgcgccccaatttctaacagcctgcctgtcccccgggaacgttctaacatccttggggagcgccccagctacaagacactgtcctgagaacgctgtcatcacccgtagttgcaagtttcggagcggcagtgggaagcatgcgggactacgacgaggtgatcgccttcctgggcgagtgggggcccttccagcgcctcatcttcttcctgctcagcgccagcatcatccccaatggcttcaatggtatgtcagtcgtgttcctggcggggaccccggagcaccgctgtcgagtgccggacgccgcgaacctgagcagcgcctggcgcaacaacagtgtcccgctgcggctgcgggacggccgcgaggtgccccacagctgcagccgctaccggctcgccaccatcgccaacttctcggcgctcgggctggagccggggcgcgacgtggacctggggcagctggagcaggagagctgcctggatggctgggagttcagccaggacgtctacctgtccaccgtcgtgaccgagtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggttcattcctgaatctccccgatggctgatatcccagagaagatttagagaggctgaagatatcatccaaaaagctgcaaaaatgaacaacatagctgtaccagcagtgatatttgattctgtggaggagctaaatcccctgaagcagcagaaagctttcattctggacctgttcaggactcggaatattgccataatgaccattatgtctttgctgctatggatgctgacctcagtgggttactttgctctgtctctggatgctcctaatttacatggagatgcctacctgaactgtttcctctctgccttgattgaaattccagcttacattacagcctggctgctattgcgaaccctgcccaggcgttatatcatagctgcagtactgttctggggaggaggtgtgcttctcttcattcaactggtacctgtggattattacttcttatccattggtctggtcatgctgggaaaatttgggatcacctctgctttctccatgctgtatgtcttcactgctgagctctacccaaccctggtcaggaacatggcggtgggggtcacatccacggcctccagagtgggcagcatcattgccccctactttgtttacctcggtgcttacaacagaatgctgccctacatcgtcatgggtagtctgactgtcctgattggaatcctcaccctttttttccctgaaagtttgggaatgactcttccagaaaccttagagcagatgcagaaagtgaaatggttcagatctgggaaaaaaacaagagactcaatggagacagaagaaaatcccaaggttctaataactgcattctgaaaaaatatctaccccatttggtgaagtgaaaaacagaaaaataagaccctgtggagaaattcgttgttcccactgaaatggactgactgtaacgattgacaccaaaatgaaccttgctatcaagaaatgctcgtcatacagtaaactctggatgattcttccagataatgtccttgctttacaaaccaaccatttctagagagtctccttactcattaattcaatgaaatggattggtaagatgtcttgaaaacatgttagtcaaggactggtaaaatacatataaagattaacactcatttccaatcatacaaatactatccaaataaaaataacatcattgtattaacgcaaatattaggtgacaacaa

SEQ ID NO: 19357 - DNA, 564 bp, Homo sapiens
  ENST00000491257
tccctggccacagacttctggaggcatcaggaggtgtactgccgtaccatatacttgtgaggtttggggtcctttcctgaggccccagtttctctaagacagcagatggcctcctgaggctcattgggtgcaaggaagcacagaaggcgaaaccccagctggaagccctggccctcagggacctctctgagcacaggtggaatctggtgtgtgaggacaactggaaggtgcccctcaccacctccctgttcttcgtaggcgtgctcctcggctccttcgtgtccgggcagctgtcagacaggtttggcaggaagaacgttctcttcgcaaccatggctgtacagactggcttcagcttcctgcagattttctccatcagctgggagatgttcactgtgttatttgtcatcgtgggcatgggccagatctccaactatgtggtagccttcatactaggccacttctctatagcatgggcagatccccaacaaaaggcagagccattgccattggtcacatctccgccccaggtgtagtgaaccaagggcagactctgtggaaagg

SEQ ID NO: 19358 - DNA, 463 bp, Homo sapiens
  ENST00000425923
gaacagaaattcttggcaagtcagttcgtattatattctctacattaggagtgtgcacattttttgcagttggctatatgctgctgccactgtttgcttacttcatcagagactggcggatgctgctgctggcgctgacggtgccgggagtgctgtgtgtcccgctgtggtggagctggtccatgaatgctcctggctgtgggcatactgtaccagggacaggacttgccccagacagaggccagcctgggaccagcactgacaagctgagtgctccccctgaacatttaccagtggtcttaccattttcctataaaagaaaatagctttcttctgaacatcccatccttgcaggttcattcctgaatctccccgatggctgatatcccagagaagatttagagaggctgaagatatcatccaaaaagctgcaaaaatgaacaacatagctgtaccagcagtg

SEQ ID NO: 19359 - DNA, 1778 bp, Homo sapiens
  ENST00000540654
agctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggtggaaagagaaactggggcagcagcaacaggaacagcagatggtcccactccaagcctcctgaggactgagaaggagcagagggtggagaggaggagccct

SEQ ID NO: 19360 - DNA, 2143 bp, Homo sapiens
  ENST00000360421
caagggtcaggtctccagcagaccctgaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcgcacca

SEQ ID NO: 19361 - DNA, 2151 bp, Homo sapiens
  ENST00000377871
gaaagctgagctgccctgacccccaaagtgaggagaagctgcaagggaaaagggagggacagatcagggagaccggggaagaaggaggagcagccaaggaggctgctgtccccccacagagcagctcggactcagctcccggagcaacccagctgcggaggcaacggcagtgctgctcctccagcgaaggacagcaggcaggcagacagacagaggtcctgggactggaaggcctcagcccccagccactgggctgggcctggcccaatggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccggcagacaggcatgggaatgggcagcaccatggcccgagtgggcagcatcgtgagcccactggtgagcatgactgccgagctctacccctccatgcctctcttcatctacggtgctgttcctgtggccgccagcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccagaagtatatggtcccactgcaggcctcagcacaagagaagaatggactctgaggactgagaaggggccttacagaaccctaaagggagggaaggtcctacaggtctccggccacccacacaaggaggaggaagaggaaatggtgacccaagtgtgggggttgtggttcaggaaagcatcttcccaggggtccacctccctttataaaccccaccagaaccacatcattaaaaggtttgactgcg

SEQ ID NO: 19362 - DNA, 1521 bp, Homo sapiens
  ENST00000458333
atggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggaaagggaaacagacgcgacagcaacaagagcaccagaagtatatggtcccactgcaggcctcagcacaagagaagaatggactctga

SEQ ID NO: 19363 - DNA, 1560 bp, Homo sapiens
  ENST00000421062
atggcctttaatgacctcctgcagcaggtggggggtgtcggccgcttccagcagatccaggtcaccctggtggtcctccccctgctcctgatggcttctcacaacaccctgcagaacttcactgctgccatccctacccaccactgccgcccgcctgccgatgccaacctcagcaagaacggggggctggaggtctggctgccccgggacaggcaggggcagcctgagtcctgcctccgcttcacctccccgcagtggggactgccctttctcaatggcacagaagccaatggcacaggggccacagagccctgcaccgatggctggatctatgacaacagcaccttcccatctaccatcgtgactgagtgggaccttgtgtgctctcacagggccctacgccagctggcccagtccttgtacatggtgggggtgctgctcggagccatggtgttcggctaccttgcagacaggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgatctttggtgctgtggacctgcctgccaagcttgtgggcttccttgtcatcaactccctgggtcgccggcctgcccagatggctgcactgctgctggcaggcatctgcatcctgctcaatggggtgataccccaggaccagtccattgtccgaacctctcttgctgtgctggggaagggttgtctggctgcctccttcaactgcatcttcctgtatactggggaactgtatcccacaatgatccgcgctgtcactgtcctcctgccagagaccctgggccagccactgccagacacggtgcaggacctggagagcaggtgggcccccactcagaaagaagcagggatatatcccaggaaagggaaacagacgcgacagcaacaagagcaccagaagtatatggtcccactgcaggcctcagcacaagagaagaatggactctga

SEQ ID NO: 19364 - DNA, 768 bp, Homo sapiens
  ENST00000537349
agctgggctcagggtgtctaggtgggagcttggcattgccagccggcgctggtttgaggatctacagcaccagcctcatacttcagaggtcctcaaaaggccccagcccaggcatcatccagggctaggccgccggaaggtactcatcttgaactacctgcagacagctgtgtcagggacctgcgcagccttcgcacccaacttccccatctactgcgccttccggctcctctcgggcatggctctggctggcatctccctcaactgcatgacactgaatgtggagtggatgcccattcacacacgggcctgcgtgggcaccttgattggctatgtctacagcctgggccagttcctcctggctggtgtggcctacgctgtgccccactggcgccacctgcagctactggtctctgcgcctttttttgccttcttcatctactcctggttcttcattgagtcggcccgctggcactcctcctccgggaggctggacctcaccctgagggccctgcagagagtcgcccggatcaatgggaagcgggaagaaggagccaaattgagtatggaggtactccgggccagtctgcagaaggagctgaccatgggcaaaggccaggcatcggccatggagctgctgcgctgccccaccctccgccacctcttcctctgcctctccatgctgtggtttgccactagctttgcatactatgggctggtcatggacctgcagggctttggagtcagcatctacctaatccaggtgat

SEQ ID NO: 19365 - DNA, 7578 bp, Homo sapiens
  ENST00000539841
atactgaggacttaccctggacctgacactctgctaggtacacaatctcattcaataccacttgcaagtaagtgacactattattcccattttacagatcaggaaactgaggcagaacaaggaaagtcacttgccactggagaagcagtggttaagagcatgagtttggaaacagacacacctaggtttgagtcctatcgccttgagcctcagctgtggcatctgtaaaatggggatgatgaacttagggtcagcatcagaacagcaggaagacccaacggagggcgatatcaacagcatccgtggggaggatgtcagtagccgtggggatgcagaagctggtgccccttcacgcggaggtgcctgggacctagcagaacactaatctggtgcttggactcctcccacagatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggtaggggctgaggactatagtctgggagcagaacccctgtgctccactcttgggctggcccctccccttgcctctgttcccctggctcacagcctataccacatctgattccctgagctcctctagaggcaccacgcctgcatctccctctcttcgtcctgcccactagctggtcattaatggcacccctccccctcctctgcccgaaggagctcaaactcaacctgcagaaggagatctccttggccaaggccaagtacaccgcaagtgacctgttccggatacccatgctgcgccgcatgaccttctgtctttccctggcctggtaacccccctctccctgcccacaccctgccaaggaaggggtgatagacaaggcctccagtaggctcacttaagggcaaggcctagggcatctgaaagagaagtcagagaatcccctctcctgggccaccacagcccagccccaaccccagaaatctgctgcattcctgccccacacccaggtccagccatcagggtctgcttccctctggggtcacaatgccccacccctcacccacaggacaaatgttccaggccccttccccagctcacatccctgccgctcagtgtccccatgctctccctctctgtcactgcccccctctgggtcagctctgccctctggaaccccacagagcaaggctagaccaatgggtttcagactcgaagacaaaaattatgtttatctcaagttttctcctctgtctgactttctcctgctccctgaaagccctttctgtgacctggtttctgcttcccatcctggccatttctttgtgaataggattcaatttgtccaggaacccttcaaagggatcccacagttcagagagaggaagggaaacatctgacccaggcatacagctcaatgctcacctcgccagtctggatgttaaactgctgcccaaccaggagagatcatttactgcctcctttggtctccgagattccctccagtcctgatcttctctagagtcagttattggcacctttgccaccacaccctggaccatgcccacgtcagacatgaccagtcaatcacagcactttctccctgagcccagacacgatctcagaaacctcaaaaggacactcaagcagcccctatcatcagttgcagttggcacaagaagtgaagctattcatcatcctggtgacccaatgaccagcatggggagtggcctctgcctggctgcaggtgctaaccaatccttctctgcctctcaggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttgggtgagagactggggctaccccagaaccctctggaagaggctgccaggttgggtgccagggacttcactgctggctctgcctctaagtcactgtgttaccttgagcaggtccctgcactctctggggctcagggtctctcttctagaaaataacgcaattgggctagatgacatgaaagctcctttccagatctgacttggactgggcaaaaagtatggtggtatctggatagtgtgaaaatttttgaggtattgagagtgtcctgagtgacatcactgtagagataagctgagatggtaaaacgacagagctcatgctcaagaaagaccccacaacctactccatcatgaccttggaaaagctacgtttattttatatgggtgttagttggttgataacacctatacccttccaaaagaacttgaggtattttaagacaagaacaagaacatatacaacaaaatataaatggaaatagaggatcagaggcaggggaaaacacaaacatagcaggacacaggcatgcaaagcattactcagctttaagtttggatctgagcttcttggaagccaaagcaaaaagggagacaagatcagctaaggagtgagaactcttaggtgctcctgaactccaaggcccaccacattttcttccctctgcagacttgcagaccgtgaggacagtattggctgtgtttgggaagggatgcctatccagctccttcagctgcctcttcctctacacaagtgaattataccccacagtcatcaggtaggtgctggacctggggccaggcccagccagaggacacaggtcaggtgggactgtggcattgtcctgtcctctacccaggggagccatcctttatgaaccccacacacaggctaccaatccctactctgaaccctcgcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtcagtcactgcctctggccccatcagtgctcctccctggggaagcaggtctgggcccagggcttttccttagctctctgtccctaggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaactctagccatgatgttcaggaatgggggtgggatgggagctggccaccgtgtggacacgtgagcatgcacatctgtccatccacacttcatgtacgacaggcctgtgtacaggcaccacaggtacatgcaagctggactgatgtgaacatgagcaagcacatgtgagtgctctgaggtgtgtacaccacgcctgtgcatgaaaatacatgtgtgtgtctacacgtcccagcatgcatatgagcagatgactgaccaagcccagagtggctgcagacagaagccagagcccctccaatcctgatttctttcccctgatcaccccaaatctctgatctatgtctcagccccatgcccagcagatagtttttctcgtgttaactgagaaaactgcaatggtagctgaccgctgtcaatatcagaaaactgcaatggtagctgaccgctgtcaatatctgctgccatgttcccggttccctccagccacagcagaacagccaatccctccaccagcagccatccctttccctctggggtctctgcccattccctctgtcttggctgccgcccatcaccagttaaacaagcttaggcttctcccaacttaacaaaaatcaacacaaacacatgccaggatgttgtatctccttccaagggccacactggctctttctccccttcgaagccagacttcataaaggagctgtctgcctcccctgtatccaccttctagcctcatacatctcccccactgcactccggctcctaccccttccctccctggaaccgctttcaccaaggacgctcatcccctccctgtgctggatccataagtcactcttcagccctcctcttactggccttttggcaaatttggtcctactggtcactctcttcttccttagtttctgagaggccacgtgtttgcagctcccccccacacactggctactccttctcaggcccctctgcggtatcctataaatgctgcagtgttcactttgcctatcctgcccccaccccttttctaaggatctgcatccccggaatctgccaactgaacagttccataatctgccatctctggtggtgaccaactagaccacagggcactccagatccaaatctcatttatcacatactctctcctgggctaggatttgagatcttaagaggttcttatccatctctttgtccttgccctgggaaggcaggttagcatgaggctaggctggcccagatgcagatagagcagagaaagccagttgcagcaagagaataaggcagacacacagagaaaaagagaacaagagaccacatgggcccagataaaaagagctggtgaggcgacttccactggttcttaatgaattccaggtctcggttcctcatcagccctggatgcgctttttaccccggggttctattaaatatccctgaattctccaaataaattcccctttctgtttaagctaacttgatgggctgctccttgtaaccaaagagctccaaaagcagctcctctcgctctaccatctcttcaacactgatttgccccaggaatctttcctaggaactcttcctgtaacattcttccccagcactgtccagtggaaatagaatgcaagccacatatgtaactccaaatcatctagtagccatttttaaaaagctaaaagaaaacaggtgaaattaattttgaatatattatgtacataatataataatatttgacccactatattcaaatattgcatttcaggattaatcaatattaacattattaattagatattttataaccttaaattcagactaagtcttcaaattctggtgtgtatgttccactagcagcatatttcagtttggactagctcaattcaagcactcagtagtggctactggctaccaccttggacaactcagacatactgcagggctttaattatcagccacagagctaattactctcaaatctgtatttagatatttgagagacagcttaataaatgtgaaagggatggtattgtacccctgcgtcaaccttctggtgacttcccactgggataaaatctaaagtctttcacaaggcctgccatgaccaggcccaacctgcctcaacagctttggtttttaacactctacctcgtacccagaaatccagcctcaactgatctttttcagatcctagactgcccctgctcttcaccatgcccagcacttggcttctccccatccaactctacagcacttggctcatgccaactcatccttaaggcctagcttggatggattcctctgaaaagccttctgtgaccacccctcaactgccccagagcctgggttgagcaccctgcttatcagacaatgaactgtgatcacagttgtgtcttagtgggtgtttccctggaagcagactcaagacaagaatttaagtccaagtaccatagattatttggcaggagatcctagaaagcacaagtaggggagttaggcggtaagtcagggaagagaatcaagaggcaagaggaaagagaatgagaagggaagaaggttctcccatcctagcccatctgtcatccagccatgtgggaagctgctgggactggccatttatgatcatgttggatgcaggactccccccttgccaacctgtagataacctggggctggcgcctaggaccagccttgtgctacactgccccctgagatctggcccttatgctgagagtgctatggggttggatggggagaagccacctagtttctatcttggaacctggtttctacctatagagtttctactgtggagcctaggatcagctgacaacagagccagcaatgcttccccttagtttgactgggtctcgacctggagggagaaggactaggctcagggaggaatactgaccccactatgcccccatctttcagttgtccggaattccgagtggctgccaggatgtcctggccatgactattcctgtgcttcagggtgcttattgcaaggacacacatgaagggaagggaagacacccaagaaaatactttccaggtacatggtcaggacttatggtgaactgagatgttgttcaggacaaactggccactcacaagacccgttcttcttgcaatccccaaatccccattctggattcctccttctctccattgctgcttattcctctacaaccccagctccgcttgctttttctactccctcccttctgtctctaagcagggactccacctggctcggtacatggagatccaatatggagcaccacttttgggcagagtcctcatgctgcgtcaactcataggtcactggcctcatgtccagcctttatatggaagtctttggatgaatttctaatttctgcaccatccgtcagccaggatagtcaggccacaaggcacaaagctcacagtgtatctcagaattccttactcagaatgttgcgaggggcctggcagacacttggaatctgctggaccctccccaagtcaatcgtttcaaacccatgcttaggacatgtgatctaagtaagagtgttttatatgatctgtaaattatgtatttgaaaaatctcacaaaagaataaaaacaaaaatcacaggtagtcccacactttaaatcccaattataaaatggaataaagttatacaaaatcagg

SEQ ID NO: 19366 - DNA, 2178 bp, Homo sapiens
  ENST00000336232
agcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaactcta

SEQ ID NO: 19367 - DNA, 2491 bp, Homo sapiens
  ENST00000451262
tgttccaggccccttccccagctcacatccctgccgctcagtgtccccatgctctccctctctgtcactgcccccctctgggtcagctctgccctctggaaccccacagagcaaggctagaccaatgggtttcagactcgaagacaaaaattatgtttatctcaagttttctcctctgtctgactttctcctgctccctgaaagccctttctgtgacctggtttctgcttcccatcctggccatttctttgtgaataggattcaatttgtccaggaacccttcaaagggatcccacagttcagagagaggaagggaaacatctgacccaggcatacagctcaatgctcacctcgccagtctggatgttaaactgctgcccaaccaggagagatcatttactgcctcctttggtctccgagattccctccagtcctgatcttctctagagtcagttattggcacctttgccaccacaccctggaccatgcccacgtcagacatgaccagtcaatcacagcactttctccctgagcccagacacgatctcagaaacctcaaaaggacactcaagcagcccctatcatcagttgcagttggcacaagaagtgaagctattcatcatcctggtgacccaatgaccagcatggggagtggcctctgcctggctgcaggtgctaaccaatccttctctgcctctcaggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttgggtgagagactggggctaccccagaaccctctggaagaggctgccaggttgggtgccagggacttcactgctggctctgcctctaagtcactgtgttaccttgagcaggtccctgcactctctggggctcagggtctctcttctagaaaataacgcaattgggctagatgacatgaaagctcctttccagatctgacttggactgggcaaaaagtatggtggtatctggatagtgtgaaaatttttgaggtattgagagtgtcctgagtgacatcactgtagagataagctgagatggtaaaacgacagagctcatgctcaagaaagaccccacaacctactccatcatgaccttggaaaagctacgtttattttatatgggtgttagttggttgataacacctatacccttccaaaagaacttgaggtattttaagacaagaacaagaacatatacaacaaaatataaatggaaatagaggatcagaggcaggggaaaacacaaacatagcaggacacaggcatgcaaagcattactcagctttaagtttggatctgagcttcttggaagccaaagcaaaaagggagacaagatcagctaaggagtgagaactcttaggtgctcctgaactccaaggcccaccacattttcttccctctgcagacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtcagtcactgcctctggccccatcagtgctcctccctggggaagcaggtctgggcccagggcttttccttagctctctgtccctaggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaactct

SEQ ID NO: 19368 - DNA, 1622 bp, Homo sapiens
  ENST00000545207
actacagcagctgccggcccctaggacagagcagggacctcaactacactgatcaccagccccatcggatccagacccggccaccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctg

SEQ ID NO: 19369 - DNA, 1387 bp, Homo sapiens
  ENST00000535878
agcagctgccggcccctaggacagagcagggacctcaactacactgatcaccagccccatcggatccagacccggccaccagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacgg

SEQ ID NO: 19370 - DNA, 1716 bp, Homo sapiens
  ENST00000311438
atgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtcagtcactgcctctggccccatcagtgctcctccctggggaagcaggtctgggcccagggcttttccttagctctctgtccctaggtccctgcgggcaaagaagccaaagcaggagccagaggtggaaaaggcctcccagaggatccctctacagcctcacggaccaggcctgggctccagctga

SEQ ID NO: 19371 - DNA, 1744 bp, Homo sapiens
  ENST00000430500
agcttgttagagctgagctgccctactacagcagctgccggcccctaggacagagcagggacctcaactacactgatcaccagccccatcggatccagacccggccaccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctga

SEQ ID NO: 19372 - DNA, 543 bp, Homo sapiens
  ENST00000542795
agacaaacccaaggagctccgagccgggctgaaaaaggaaacggtccttgggagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaag

SEQ ID NO: 19373 - DNA, 648 bp, Homo sapiens
  ENST00000542904
cagacaaacccaaggagctccgagccgggctgaaaaaggaaacggtccttgggaggtaggggcaaagtcagggcgctgggagaggaagcccacatgtatgaggccacaggctgagcatggctgagcaggctgtctacactgagttaggctagccctacctttctcttgtgcagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcct

SEQ ID NO: 19374 - DNA, 521 bp, Homo sapiens
  ENST00000544707
agcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagaggtatgcctgggcaaaccctctccctccacttacccacgtacccccataccct

SEQ ID NO: 19375 - DNA, 3929 bp, Homo sapiens
  ENST00000328041
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccagccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgacccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgagctgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctatccttcccagagcagagtgcattactttctcccctggaaa

SEQ ID NO: 19376 - DNA, 3694 bp, Homo sapiens
  ENST00000613834
atgcggccgtccggcgacgaggaccgcgcgcgtcgccgccgccgccgccgccgccggagggaccttctgctgagccagctctgcttcctggcctcggtggcgctgctgctctggtcgctgtcgagcctgcgagagcagaaggagcttgacctcatggacctcgtaggggaagacagaaagtggatgatggcgaggaagctgatgcaggtgaacgacactctgacttccgaagatgccggactccggaacagcaagaactgcaccgaaccggccctgcatgaattccccaatgacatcttcacaaacgaggatagaagacaaggtgcggtggtcctccatgtgctctgtgccatatacatgttctatgcgctggccattgtgtgtgatgacttcttcgtcccttccttggaaaagatctgtgagcgcctgcacctcagtgaagatgtggctggggccacattcatggcagcgggaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctgctgagggattctatttactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccacagaggctcagctccttcttttctgtgcaatacgagacccggccgcaccccgagtcacacaggcccccggggccacggcgttcgtctctcctgtgctgtcctcaggcctccgctcctgttttggtggcccaggctctcccctgacccatcctcgctcccccacctccttgggtcatgcccacccaccctttcctgcctcctccgtgtgaagacatccaacatccacgtgacttttccagctccatttttgaacagtgactgagattctagaaaaactggctgctaactggcctgagccaggcaacactgattccaatccctcctccttttttaagttatttgatggaagactcacctaatttgtgacctgagactgttgaagaaatagagaggagggggcccgttgattacagagagcatttgggattttgtttggtttggagatgatgcctaggttactgggtttggggggattgttttcttttgggggccttccccttttactccttttcttccagagatcaagagcttctcttgcatcttcttccactgggctctggattaatcaattacccaaaggctgcacctgccgtgttgtctgggcttgcatcccagatgtgttggagtatgcatggatgtagtgctttttagaggagccactgggcaaggccaccaagaacaaatgcatgacattttatagccaaggacgcctcgctaaagtcttatgggcgtcccctggggttgggggggcacaaggttttggaggaagaagacaacttccctcattccatcatcaccatctctttctcactaggttctttctagttttcaagcaatagttctagcctgccttggacaagggggccccagttaaacaaactacccatccatgagctgccaggcagtcaaaaacagaagcttccccgacttgtgagtccctgagatgtgctcttgttgtttggcatttggggtgacagggagtgacccagaggccaccactgcttttcatgcaggagttacagacactggtttcttggaaaatggagagaagcgcactttgcacagacgtcgtcaattaagtcccaatttgccacttggtattgagtacactggaccctgaccactggctcttgggcaaacgtccttcctcacggggcgcctccgccaagccggcccagctgcacccctcccttcctggagggatggccagggaaggagaaaacagagaactgacacctttgaaaccacagaatgtgttacatgcagactcgctcaagggcataagttattgtgaacgtttttgccaatcactgctcaacagccctgctagattttgtatgatgctgaattattatgcagactaattccacccagttgagacacaccatgcttgttcacttgtatttattgaaactgtggattcttgcccgtgctgtcccttgtatttactttaagcactgatcacttatcattcattcggtatggttttccctgtcccttgtacacattctggtatgaatttgtaaaaataacctgctacaaattggttgaatgtttctgtctgtggtgcgaaccagcattaacggatggggcacgtgcccaactgaggaacaggagaagaaatcaccaatttgggctctcagagctaagacacacttattgattctgttgcacattttgcactggtttatggcgattgttttcttggacggatagtgtaaaataaacttctctgttctctatc

SEQ ID NO: 19377 - DNA, 4417 bp, Homo sapiens
  ENST00000393265
gggcccgcagatctctctggttcccctctctgccccgtctccagcttttttgcagggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 19378 - DNA, 4531 bp, Homo sapiens
  ENST00000531433
agagagaaagttcccggggagagctcgcccctgggagggccgacgtcgagcctgctcgccgcgagggtctcagagacggcacccaggcgctccgggatggcgctccgcgggaccctccggccgctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctgtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 19379 - DNA, 9950 bp, Homo sapiens
  ENST00000532405
gcacgcggcgcgcgggactctgagctccggccgcgtcgcgcgtccccaccttcccaaggggctcccccgccgacctcgccctcgggccatgaggctttggcccggagctcctcgcctctgagtcgcgcaccgcctgctccagccccagcgccgctcggccactgattgcactctggccgctgaagctccccatcctctcccagagacggcacccaggcgctccgggatggcgctccgcgggaccctccggccgctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaactatatgtacactgtaggtggaaaattctcttttttaactaaatatttttccatcacaaatttaaagaattgcatgattaattaggctttcatttttaaattacgctttcatcactacgcaggattactttattttattcccaaagctcattagcatgggataattactctgctacagaaataggcaatttaaaaaaatgaatttagctcttctcattgggggcagaaaagaaaaaaaaaaccattgcactcagatggaaaatgcctatagacacaggagcaggtggttcctgtggacttctggtttggaattttgcctcaccaggtcaagcgtggttagggtggaaggtgtccagtatcttgaaaacctggccctggaggaaggttctgggtcagctgcaatgagagactggtgattaagggcaccgtgggcaggacacagtcctcgccttacccaccccatccttcctgttacccacagtctgctggcctccatgcctcttccccttgtcacttgtgtctcctccttatgcacagagctgcctgcctttatgaattttcttttcttttttttttgagacagcgtcttgctgtgtcacccaggctggagtgcagtggtgccatcttggctcactgcaacctccgcctcccaggttcaagcaattcttgtgcctcagcctcctgaggattacaggcgtgcgccaccacacccagctaatttttgtatttttagtagagacgggttttcaccatgttggccaggctggtctcaaactcctgacctcaggtgatccacccacctcggtttcccaaagtgctgggattacaggtgtgagccaccacgcccagcctgcccttgtgaattttcacctgctccttacccctcacctgttaggactgtttcttgcttttgcccctgtcggtcccctgccttaacagacctaagcagctgataatgcaccaagcttccctgaccaggtggggtgtgtctatcacccaagggcagtcctacagaccctgaccaaaggccgttcctgggcggcccaaggtccaggtttcttccacctgctcttccctgtttatggggatttgcaagcctaattgcatcagcaggagcccatctctcagagaacccggactccccaagcagactgggattttgggaagggtgtggggggtgtcattgctggatacccgtctttctgcctgtcctttctcctctctgaatcctggggcccctctccctccttaaagctggagtggacagagggacaggagaggatcagagttcatcccccctgggaaagagcaagagcgaatgaatcccagcgccagcggctgaggctgccttccgtgccttccctccatgggcgacgggtgagtggggcttaggaaactggaacagggaaggttctgttaccacactttggaactttccccctgggattcagcagttgagaagcagagacctttctgccctgggtgaatgggtccttgggggaggggttggtcttttgtctcgcatccccatctttcctttccttctgggccatgctcctccctggctggaaaaaggtggctgtgctgtccctgtgatccactctcagcaaatgcgtgtggctcaaataaacaaagaacttacctgttagagtgaaaatcctcaggagattgtacccaaatgccatgctctaaatattcatggtctctctaatgccctcaagacgtgatttccatgggaaccatcctcccctgggggcagttagcaggagtacgtggggcacgtgaggtggtcctcctttcagcacaccgtgcccatagaaacttctagaaatttctgaaaatgctctgtgggcagctcttgggtggcagtaagtccatcaacccccatctaccccgggcctgaagcgctgcgcttgctctctttatgtgtgtgcacccgaaggatttcctggtctctgtagctgatcctgtgagcccctcaagcatgaagcctcccttggggcttctcaaagcatggagaggggcccttcctgtcctttgggaaaatcttccccactgtgtcagttatatgggaacaagagtgatggggtctttctctaggcctgtgccacaggacagagaacacgggattctgctgttcgctttgagccacagcctttaccagcccggcttgtgtggggggccccttcgccttgctgcaaagagctgttccccaaagggcatatccacagggtacaggttttaaaaaggcttttttttttttttttgagacagggtctcgctctgtcgcctagactcagtgcagtggcgccatgttggctggttgcaacctccacctcctgggttcaagtgattctcccacctcagcctctctggtagctgggactacaggcacgcgccaccatgcccagctaatttttggatttttagtagagaaggagtttcaccatgctgaccaggctggtttcgaactcctgacctcaagtgatccgcccgcctgggcctcccagagtgctgagattacaggcgtgagccaccgcacctggccaaaaaaaggcattttgatttaggttgctgtgtttgcttgttgataaagaaaactcaatcgggacactagttttgtgctcagctttaggccgggtagctaatgggaggatgtccagcctgtcactgtgctcccagcgcaaggaaatgggtgcccacctggaatcaggagaagaggcttttccctcctgttctgcaaccagggtggagctatctttccagggaagccagctgagaggttttagggctttggttattttatgggggttttaaacctcctaacttttcaatgacaaatggctcccaggtgccatagtctctgttaaatcctcaaacattcacaagcacacactgccaggggcacgggttgtctttcacctgcatgtttctaaggctctttattcaatctcacggtgtcagtgtccagttgtcaaagttatgaatcttcctcctgcttctaaacagggctgacagtatactctcgtctagtctaggaacatgtctgctgctgggataccctggtaccaggatttgagggccacgggtggcatctctgagagctgaaaatccacagagtgcctgtgggaaagccaagcccttggctgtgtggcttttctatcccttggatttacaggtctgggaattggctgcttcttagttataaccccagtgacaaatgctggcttaagccacacctgttcccactgttgctagaattcaaacagttgctttttttttttctttttgagaaagggcctcactctgttgcccaggctggagtgcagtggcttgatcacagctcacgaaagcctcaaactcctaggctcaagtgatcctcctgaaaagtaggtaggactacaggcacatgccaccacatacagctaatttgttttcattttttttttttttagagacaggatctcgctgtgttccccaggtaggtcttgaactcctggcctcaagtgatcctcctgccttgacctcccaaagtgctggattacaagcgtgagcccctgcacccggcccaagcagttgcttctttttttctctttttttttttttttgagatggagcctcactctgttgcccaggctggagtgcagtggcgcgatctccactcactgcaagctccgcctcccgggttcatgccattctcctgcctcagcctcccgagtagctgggactacaggcgcctgccaccacacccagctaattttttgtatttttggtacagacagggtttcaccgtgttagccaggatggtcttgatctcctgatctcgtgatccgcccaccccggcctcccaaagtgctggattacaagcgtgagccaccgcgccccgccaagcagttgcttcttatgcaacatgttggttgggacttgtccacgggccaggccaataaaattcttaatcctgcagagagtcagtaccctcatcaccccatcactggaaaacaaatgttttaagctatcaagagagggaatgtgcagcttttggtttctagatgcatggtttggtgtgatctacctttgtgcctaaagggaatgtcccaaacaacagagccttctttgctgtcactccagaattctctacacagaatttcccaagtccattcaggacagacgcgcagtcctctttcaatggaagaagagaggacttttcccctcctgaaaaatgactggagtgtgaacaaggcagctctgtttttctaaataagttgttcttgtgagttttttctggccactgggcatctctgccctcacttttcatccctgccctctaagctgcagaccccatgaccacactgtctgcttccttgagcttcccgcacgaggcttggacctgggggacctggagaccctgcggacagaactgtggctgagccactgtggccaactcttggggagctccacagtgggggttgctggtctgtgaggctgagtctccatttcagagcacacactccctggcagggcgcctctgcctgtgtctcctgcccagcagccgccagcagggaatagttgctggtgtctgagcacaaagagagctttgattacctagagaggaaaaaggctgtcagccagatgcagccaggcccaggggtagatacaggagttgctaaggaaggggccgagccaggagaggccaggcagatccacaaagcccaaggggatgcaggctgggtgtggtttctgagggaacctaccaaatagcaggtagatggaatcagaggactcttgtgtcctgaaagaacctccttaaaaacaactaaaacgaagaacttctggggctgttcacacattgttcaagtcaccccaagatcgttctggcacgctgagctgaacaccaccatctttgttcattctctctctaatgggcaaagcaggatcatcgagttgaaaagttgtaaataatgaggatatttatcccgctatttattttttcaataactgtgacctcctgcactgtgaatgctctgtgacatgagattcttagtttaataaaactgtcattaaatttgaatgaattgatattattggttactgaacactggcatgagtttatttttattgtgaagaaaaaaatctacagcaatctaaactaaacctttctaagaaatctagcagtcagtattgtaatgcaatatatcaaaatctgtacactgtcaataaaataaatgagcacaagt

SEQ ID NO: 19380 - DNA, 334 bp, Homo sapiens
  ENST00000554461
aataagtgcctgtgtgttggcaactgcagctaaagctctcctatctctgcaaacatcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatc

SEQ ID NO: 19381 - DNA, 4187 bp, Homo sapiens
  ENST00000525557
agtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctgtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcacctgctccagtgaggttcctgggatccagccccaggaagccttgatcgagggacaaggaggaaggcagtggaaggaaagatagaaggatcagggaggaatgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaacta

SEQ ID NO: 19382 - DNA, 1616 bp, Homo sapiens
  ENST00000554925
gctcatagcagccaacgacggggctctgctggcaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctc

SEQ ID NO: 19383 - DNA, 3386 bp, Homo sapiens
  ENST00000556739
gggatggagtggtctcagatgtgtctgggacatctggggtgcagaatctgtatttctgggccccctctccagtcatcatcctggagccgatgaaggcaggggcttcctcccatgtgcattttgggagtctgttctgccctgtctcaggtaacccccaagagggaggagtctctccgtatagaaggaggaaacctgccagggtggcggggtgcggtccaggccacagcctggctgctgaggcccacccacaaaggacagagctgaggagctgatgggcatggagtttgattcgtgtgtcgtgtttcataaatgctgagcagactaccccaggggaagcccgtttccaggacaacctcagaaggggaaggagccatgagggcggctgtgtcggattttagctctatggacgcagtggccccgagacggtccccacacacagcctggtccccacacacaggctggcaggacagaggctggttgctgccctgtcgtatatatggtgcttctgggtcctctgggccttcatggtgaagaagagaagtattgtgtgctgagtcactcaggccagtggcagatgcccatccaagagccacccaccacctgtgccaacccaggagacctcccaggaccctgcaggaaacattcctcattcacagcatgggggcctcagctcctcaccttcccagagcaacccaggctcccagaggcccccgcctacacagtgccttttctggcactgctgtgactgtctccatcactctgtgcctgtgacagtagcacttccttgcaagtttattttctcccaaatctctttaagtccaggacattttctggaaaactggaagactggacacaggactgcccccaagcactggggaaggagggagaatcccatcttcctgcagcttttatcagagggaatgcatttagataagggccaagggagaaaacagtcctcagaaagtgtggagggaagtggggtacaggcctggacgcctggaattggagaaaggggagacctggagaggcagacgtggggatttcttcaccccacttttactgcccctatcataagaggctcccagagggccatgtgtgagtcactgttctgcactgtcccctgcgtagactcgactgaagcaggaggaaggagcccccggtaacaccctgggtgggactggggaggccagggctttggggcttttcctttcctaagggcggtgccatggaatcttttggctggagatgacattggggtttctttccctgtgcccagctccaagcaggtcgctgtgtggccaccccacccaaaggaatgcacgggttgctggctgggagattcttcaagagcacacactctcaggcccgatcgagctgttctcagtttttgggtttcccatagaaaacccaaagttttatcttccagcttcttgacaggaaaagtgggcagaaagccttttccccaccacactgataaaaggcgtttgagtactgaaacgttcttaaaggctgtgtggcttggctcaccaaagcagcctcctggtgcttctcaggtggccttgaacacagcctgggccacttgcctgccggcctcgcccaggaggcacactgtggacccttccaggctgccctggccctgggcacagccttggtttggagtggggagagttgggggtgatgcctggcctggggctggactgctgggagaatgtgctgtcattgagttcttttcccggcagccactccgggcatgggcacacacccttgttctgtcattggtcaggggacaccaggacaagctgtcccgggaggcaggcatcctggggaaggaaggagaattccatcttcctgtagcttttatcagagtgaatgcatttagataagggccaagagagaatactacctagagagtgtggaaggaagtgggggtgcaggcctgtactcctggaattagagaagggggaggcctggctcttgtctcacagactccaggctctctccttctgagcccagttgttcctccagcagtacctggcatggggttggttctgtaggatggagcctgaagctgcgttttctgtgggttccgtcttcctctgggatggaggcttctgagcagggagggatttgagctttcatgcagcagtgaggggctgagggcatgagctgtggagggggctcctgctcctcagagtggaagcagagccatcgaatcagccaggacaggagtcatcccaaaggccagaggccccaagtgttgatgctccccatagaaggagcccgctaataacactctccagcacataacccctggcatcttcgccaccaccaagagtgctgccccagactctcggcacccaccgcacgctaatcatctctggcagtttctgttggcctttgtctccttaactctcctcctcttctaaatttgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggccacagcggcctcctcactgtcattcctagaacacactgtcattcctagaactgcgcacctgccccaggacctttgcacctgccttttgctggaatgcagtttccccagctccacaaagcaggtacttttgtctactgcatttatctgcatccccagtacccaggactggccacatagtaggggcttgctgtgaataccctcaagatctggtccagccgggagcagagtcccaaagcaccagcccagagctgtcatgaagccagcacatggccttaggctggagtgtagtggcatgatctccgctgactgcaacctccgcttcccgggttcaagagattctcctgcctcagcctcccgagtagctgggagtacagacacataccatcacgcctggctaatttttgtatttgtagtagggacaaggtttcatcatgttgaccaggctggtctcgaactcctgacctcaagtgatccacccacctcggcctcccaaagtgctgggattataggcatgagccaccatgcccagccgagacagggtgctttatacacattaagtcattaaacccattaaaacccta

SEQ ID NO: 19384 - DNA, 4747 bp, Homo sapiens
  ENST00000526482
aatgcatgttctcctggctttgttttctaacccacacgcctcctgtctgctgagccttgctgcctgtttggtgaggagtgtgtgtgtctggtgtgcttttgtgctattaactcttacacgggtttgctctccggacctattcgctggttaccctaaaacccgtaaaggacacaccaggagctggtaaccagtgcagagggacagtcctatccatttttatagccctttggaggggaacactctgcctgcttctgcatgctgtgttcatgagcagttttgtaactagaccctcctagggatctggagtcaaatgtgaaattcccaaggataccggcccagtgcaggtttatgaagatggcaagaaagaggtctggggacagggagttttgttcctccccattgtgaggggaaggaaagggtcagagagaccagcctccctccggagggtgtcagggtttatagtcactgggctcagccagcggctcaccgtgcaccctcaaacaagcaggctcctctcctgggtcttagttgcctgtctaggtcccatgatctaaatctttgacctcactacttgcccttataaagaacaaagttacaagcattctgtcctgcagacagagcaggtggcctcgtaggaagttcagagccagtgcccactgctctgcaacattttccaccccggggacccttgtcaatttgcaaaatttcatctgagcctctgtacgtgggggaaagaaaggtcccctcatagtcatgggtgaaaagtggtaggcccccgtgtgtattgtaggttggctgccctggtaaggcttagataacgaactgaaagacccttgtaattagccaagactgggccccagaagagaggcgaaaagagcatcaattgcccacgagtggtcctggagcaaggggacacactgggcttcacacactaggtcagcaggtgtttcaaagctagtgacccactttgcctgacatgaggagttgaagccaggcatccagacttcccggtggctgccagctgccaggaccacagcctagggcagctcacaaggtgaggggaagtcagtggccccagcacttgggtgttgtcctcagagagatcagcactaatcacggtgttgcgctcaacagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaacta

SEQ ID NO: 19385 - DNA, 2244 bp, Homo sapiens
  ENST00000327451
gagactcctgcaggttcgagaaagcatgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcag

SEQ ID NO: 19386 - DNA, 2057 bp, Homo sapiens
  ENST00000399813
aggttcgagaaagcatgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcagggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggct

SEQ ID NO: 19387 - DNA, 583 bp, Homo sapiens
  ENST00000496051
atgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcaggtaagtgtcttgtctgtctgcatcaagctcagagttggtaggaaaagactcttctagcaaataaaccattgggggaaaggggaagagcagccagtgggacagggacactcatcccatttgttggatagagtcagaaggggtgggcacgaggaagtggccgcccctgaccatggggtatcccaggcaacatccaagccaggaagcaagtgattttcttggcaataagtcaagaactggctcctggctactagtgtgaggggctcattcctg

SEQ ID NO: 19388 - DNA, 2454 bp, Homo sapiens
  ENST00000467228
gatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgaggtgagctcggctggggcagcctgaggccctgggccctgggcctggcggagagtcgctgtggtgatagcacatccaggtttctgaagaacaagctgagtcctagggaagagcaagacccctgtcccccatataacatatacactacatctactgtggcaaatacgtacacacaagcatctgtgcacatatatgttattgttcaacatagtttaattgtttgggttcatcttctctaactacaaaattaagtttacagttctctttatcgtcccaagtttcttcctttgtgaaaggcccactatcatctactcttaccacttccaggtaaatccatctccaaatattttgttcacagtctgcctcccgcctgaaagataagaaaagttgagtgggttccaaggagtctgagaaagctttgttttctatttcccgtcttccaaagctcctatacccagcagggtggggggccatgttatctaaactgtggctttacttttggctggaactaggtcacctcaagggctgaccgacttgaagccttcactgtgggaagtgcctgctctcttattatgaacaatagctggcattcccccccaggcacggtttccatagtcctcagcaaccctggagtgagttcgacgggaatgcaggcccagagaggagaggtcacagtcaggatgcaaactcagttctgcctgaccttcagtccgtttgtgtgagaactgcacacgtggctccaggcctgcggaggagccagaggacgggccggggaagcttggggcagagcggtgccctggtggcggcccatgggggcagagctgggctcctcccagaagcccctgcaggtcccagctccagggacttcccgggttgcagcaagatgcctcacccgggtgagtgcggctgtcctgtctggaccagacctgggccagggaggctgaagagggtctctggacacctgtggggctggggttccccactgtctgtgcccctgcccattcctggctgcatccgctccctaacctgcccctccctctgcctctctcctccccctgtcctccccctgtcctagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggtgggcttctcaggtcccctgggaggctgggcagcaggtgtgagcgtatgggacatggggaactggtgttccttccgttgctgcggggatggggccagggctgccagggggtccttcctgatgagcctctgtgctcttgggtggagacagaggcagctctgggtcctggtaaggcttccggagacccacagagcacaccccccgccaccgcctcagtaagagcaggcgagccctccctacctgcctgcctctctctgcctggctagaagcgaagagagagaggctgaaagggactgagggacggggcctgagctcctggcaaggagttctgggtggctcctccccagctcggtccagcgttgctgcggtccctgcggggtccccagccaggaggtaccttggacaatggatcccaagctggagttgagccggagctcgtatgcttgtgccgccgagaagcaaaacacaaaccctagacagccccgagctagcagccaatgggactggcttgtgcggcacagaggagcggaaccccagtccctgcgcctggcgcctgtcactggaactgctgttttatcatcagcgaccccaccagcagcaacaaaaataaaatggcttcctgataaccaaactgaggagtccgtaagaaaaaaatacgtaaaaaggggagaatgtggggccgggcgcggtggctcacgcctgtaatcccagcactttgggaggccgaggcgggcggatcacgaggtcaggagatcgagaccatcctggctaacacggtgaaaccccgtctctact

SEQ ID NO: 19389 - DNA, 845 bp, Homo sapiens
  ENST00000497401
gtaaacagcaacctacttgccacctggggaggtgcagcgtggcttgactggatagtagcctctttgggttttgcttcaaacccaacctatttgaaggtgcagtgtgcggtgagagtctggaaccctgcagtggtgatgagggggaggcagagggagggaaactgaccacagaagggaaaaccagtccaagctggctgacactgaaagccacctctccctgcagctcagcagcgatctgaactatatcctgggttccagaaaaggcagaggttcttaccgaaagcaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgac

SEQ ID NO: 19390 - DNA, 560 bp, Homo sapiens
  ENST00000469889
agcaacctacttgccacctggggaggtgcagcgtggcttgactggatagtagcctctttgggttttgcttcaaacccaacctatttgaagctcagcagcgatctgaactatatcctgggttccagaaaaggcagaggttcttaccgaaagcaggtaagtgtcttgtctgtctgcatcaagctcagagttggtaggaaaagactcttctagcaaataaaccattgggggaaaggggaagagcagccagtgggacagggacactcatcccatttgttggatagagtcagaaggggtgggcacgaggaagtggccgcccctgaccatggggtatcccaggcaacatccaagccaggaagcaagtgattttcttggcaataagtcaagaactggctcctggctactagtgtgaggggctcattcctgggaacactcacccttgctctgctaataagaggaagtaggcggggacgtggtcatcaccctgaggcccccaacccagctcctcacagtgggaataaatgagcacagctctacagtggagccagcagtctcgtgacaag

SEQ ID NO: 19391 - DNA, 2385 bp, Homo sapiens
  ENST00000359232
cactcggcgcccccacccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaagtggc

SEQ ID NO: 19392 - DNA, 5169 bp, Homo sapiens
  ENST00000554912
ctgccacccaggagaaacagaacatggccagccctctggaagtcttccctcctgctcctatcaactcctccctccccttctgaggcttccactggcctaacttcctcctttttttttgagacacggtcttgctctgtcaccctaggtggagtgcagtggtgcaatcatagcccactgcagccttgatttcccaggctcaagcaatcctcccaccgcagcctctcaagtagctgaaactacaggcacacaccaccatgcctagctcatgttttttttgaagttattagtagagatggggtcttgatatgttgcccagctggtctcaaactactgggctcaagtgatcctcctgccttggcctcccaaagtgctgggatgacaggcctggcccactgtcctcacttccaacaccacgggtcccttttgcctggttgaatataattgcagctgtaccctaggatcatcaggggccacccgagtctgtgtcagtccgtactgtcacatggccacagactatctcatggctgggacagtcacagtttattcccccaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgagggggtgaccggccatccctgggcatgggatggggagtgtgggtgggggctggctgtgggggctccgcgcctggatgtgatgttgaaattttgtgttgctttaaccgcctttactttctgagctaggggctgtctccatccatagcaaaagtgtaactttgttgtagatgggcgtaagcctcaccctggagagcgctagtaagtacagaccaggtgaaccagatcccagcctggaccccaccctgtcatgcccatctccccaaccccagagttccctccgtagcaggggacagggagggtgtgaggcaagcttgggctcagcacaggtcctggggtgggggctcgggctggccaaaaaaaatcagccccctctggattgggggtcctcatgtgggggtctctcggccctatggggagctgggagcttcctaaacttgtgtccaaatgactagtttcccaggggtgggtccgttcccatcaatcctcaaaggagagcctggcaccccaagattttaagagcctgagctataaatgacaagacttgggacactgggccacagttcctctcccagagagcaagggctcgtcacagactgaggggtactgaggggtcagaaacaaagtggggagaggcctctgcccacattggtgggagaagctgagttgacctaagcctgacattccccagccggctggacttgggcattcaccagtgtctgtgatctgcaaagacttcacaacactacccaggtggcactgagtatccaacctgggaagggacagctccatgtcacatcagttctactcacacagccctcttagtgccagtgttggggctgcaggaggaacagagatccccccagaggccccagaacattgaagggagagcagcaaacctcgcatcaaggtgttggccaagaactgggcctccagggtgggagggtgcttcgggccaatcttgaagcattggcttccagctgttgaggtcctgggggtactgagatggtacttgtttcctaacaaaacattttttataagtgcattcaccaatagagggcccacctattctggtggagagaattggaaaaggttccagaatccgggcagaagcctggctgttcccggtgagggctctcccttgctagcactccctcccaccctcactctgagcaacacagctgctcatgtccctggagaggacagctttggccaagttgttaaacatctctgagcctgtcttcccatcttggaaatgggggcagttgtcccaatgccgagataattgagtgtgaagccctcccctgtcccatgctgcctagtaccgaaggcacttgctctgtggccctggctgtaagaatgatcatttctgagtcagacctagggaaccagcccctgagaatgtgacttgacctagtttactcccaccgcccgctctgcaactctgagcctcctattgagcaaagataagctcataggcaacaaagagcactttgacatggaagaggttctgggccactgggctcggaggcagcggggcctgaccagcgccccaggccccagagctgctgacgtgggtccccaaggaggttgttggctgttctcttgccaccactctattaactcataactgctgttctcacgagaggctactggcagagaccaggcaggagctcctggagccaaggtcattgcttttatttttatttatttatttattgagatggaatgttcctttctcgcccaggctggagtgcagtggcatgacctcactgcatcctctgcctcacgggttcaagcaattctcccacctcagcctcctgagtagcagggattacaggcgtatgccaccacactaggctaattttttttacagacacgatttcgccacgttggccaggctggtcttgaactcctgacctcaagtgatccacccacctcagcctcccaaagtgttgggattacaggcgtgagccactgcacctggccaggctcatcactttttgcgcctattgcctcgaagccagtctctgatgggacattagggcaggggcccttcagcctagtctgggacatgggccgctcactcagcagtatgacaagcatcacctggagaacgggccagtctcaggaggtcgttcatgccccactggcagtgcactgtgcagccatagtgtaaacaagaggcttaacctgaattggtctgagatcttggggaccccctaccctgtctccagcagcctgtccctttagctgtttgcctactggcaccccatcctgagaaggcatagatacccggcccaccctgccctggaattacaaaagtcttagactgtgcctgagtgcccggcctccttgggagaccctcctaggcagcctaagcaccagacccgggagctgggtgctctggtcctgcctgcctgcctctcactggaccctctccttccaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 19393 - DNA, 2242 bp, Homo sapiens
  ENST00000392908
gagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgtttttt

SEQ ID NO: 19394 - DNA, 1540 bp, Homo sapiens
  ENST00000556505
tttgtgttgctttaaccgcctttactttctgagctaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaact

SEQ ID NO: 19395 - DNA, 960 bp, Homo sapiens
  ENST00000555927
agcaataatcagggagcagttgtcttgacctatgatgaggggatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataa

SEQ ID NO: 19396 - DNA, 1124 bp, Homo sapiens
  ENST00000554224
ccgcccattggcctcactcggcgcccccacccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgt

SEQ ID NO: 19397 - DNA, 1025 bp, Homo sapiens
  ENST00000556715
gggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggg

SEQ ID NO: 19398 - DNA, 569 bp, Homo sapiens
  ENST00000554291
taactgctgttctcacgagaggctactggcagagaccaggcaggagctcctggagccaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcggg

SEQ ID NO: 19399 - DNA, 674 bp, Homo sapiens
  ENST00000554060
cggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggca

SEQ ID NO: 19400 - DNA, 1067 bp, Homo sapiens
  ENST00000556868
ccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgagggggtgaccggccatccctgggcatgggatggggagtgtgggtgggggctggctgtgggggctccgcgcctggatgtgatgttgaaattttgtgttgctttaaccgcctttactttctgagctaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctc

SEQ ID NO: 19401 - DNA, 675 bp, Homo sapiens
  ENST00000555475
gcaactctgagcctcctattgagcaaagataagctcataggcaacaaagagcactttgacatggaagaggttctgggccactgggctcggaggcagcggggcctgaccagcgccccaggccccagagctgctgacgtgggtccccaaggaggttgttggctgttctcttgccaccactctattaactcataactgctgttctcacgagaggctactggcagagaccaggcaggagctcctggagccaaggtcattgcttttatttttatttatttatttattgagatggaatgttcctttctcgcccaggctggagtgcagtggcatgacctcactgcatcctctgcctcacgggttcaagcaattctcccacctcagcctcctgagtagcagggattacaggcgtgagccactgcacctggccaggctcatcactttttgcgcctattgcctcgaagccagtctctgatgggacattagggcaggggcccttcagcctagtctgggacatgggccgctcactcagcagtatgacaagcatcacctggagaacgggccagtctcaggaggtcgttcatgccccactggcagtgcactgtgcagccatagtgtaaacaagaggcttaacctgaattggtctgagatcttggggaccccctaccctgtctccagcag

SEQ ID NO: 19402 - DNA, 797 bp, Homo sapiens
  ENST00000553359
cactcggcgcccccacccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcgggggccatccagcggggttggggctacggagccgaccccctactcggctggccttggagggcactgaaccactctggcgccgagtcacgccttggaacgccgccccttcctacgcggttttgtgtggcaggcgtgcttgtgggacacccgtttgacacggtcaaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgagggggtgaccggccatccctgggcatgggatggggagtgtgggtgggggctggctgtgggggctccgcgcctggatgtgatgttgaaattttgtgttgctttaaccgcctttactttctgagctaggggct

SEQ ID NO: 19403 - DNA, 569 bp, Homo sapiens
  ENST00000556873
ataccctcccagtggacgtgaggattccaggggctcatgggatctgcctgctgcacccacaggtgtggcaggcgtgcttgtgggacacccgtttgacacggtcaagggcaagctgtgagtggcaggcaccagaccagccttgtgcttgctggcagcgctacacgtggccgctcttcccactgagcaaaggcacagctgacggcaaggcaggatgcgcaccctgagctgggtttgcgggagacttccagtctccttttctggtgagcctaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgagggggtgaccggccatccctgggcatgggatggggagtgtgggtgggggctggctgtgggggctccgcgcctggatgtgatgttgaaattttgtgttgctttaaccgcctttactttctgagctagggg

SEQ ID NO: 19404 - DNA, 323 bp, Homo sapiens
  ENST00000553574
tgtgtgttctgaaagtagcccagcggggcccttccttgctctttttccttggccccagggcaagctgtgagtggcaggcaccagaccagccttgtgcttgctggcagcgctacacgtggccgctcttcccactgagcaaaggcacagctgacggcaaggcaggatgcgcaccctgagctgggtttgcgggagacttccagtctccttttctggtgagcctaggcccttgggactgaaagaatccaagatctggatctcctctatagcgcccagaaccacagccaccgtcctgaagcacacggccttcacacgtttctacacga

SEQ ID NO: 19405 - DNA, 371 bp, Homo sapiens
  ENST00000555051
aggtgtttggattaatgggatatcccagaaatagtgtgtgcagcctcccaggggacaacttctgctgtcagccacccagaccagtcagccgcggagagcagcagcctgcagatgggacaccagtgctgagtgggacaggtgctggcttggccttgggatgtcacatgcataccctcccagtggacgtgaggattccaggggctcatgggatctgcctgctgcacccacaggtgtggcaggcgtgcttgtgggacacccgtttgacacggtcaaggcccttgggactgaaagaatccaagatctggatctcctctatagcgcccagaaccacagccaccgtcctgaagcacacggccttcacacgtttctac

SEQ ID NO: 19406 - DNA, 550 bp, Homo sapiens
  ENST00000555949
actcggcgcccccacccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaagggcaagctgtgagtggcaggcaccagaccagccttgtgcttgctggcagcgctacacgtggccgctcttcccactgagcaaaggcacagctgacggcaaggcaggatgcgcaccctgagctgggtttgcgggagacttccagtctccttttctggtgagcctaggtgtgtgt

SEQ ID NO: 19407 - DNA, 534 bp, Homo sapiens
  ENST00000557438
agcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtgagtctcatcgctgcttttttttcctcggcgcgtacattggagagaggctcacagggttggggtggctggaagcctgtttccgtgtacagccccaggtgggcagctgcttttacaccaggccgggttgaaccttcctcactgctttgtcctggcatctcccagctggggctgatccacatgctgggttcatggccaagtccatcctgggcttggccagctggaaccgaggtgctgaggtttt

SEQ ID NO: 19408 - DNA, 756 bp, Homo sapiens
  ENST00000555888
gctgtctccctgggctcaaggtggctcccactgagggaaggggacggaggtatcagccagtgcatcaggacctggggtcgtcactcccaaggggccattaccctgttcagtctccgtggccactctgggggagggaggtaaacctttacaggtaaggcccagagtgaggcccagagacagagtcatttgtgagcacgccaggctgatgagcggcagggggaaaattcaaatctggggagggtctgaccccaaagtccaacatctctggagcctcctgcccatgtcaggtgtttggattaatgggatatcccagaaatagtgtgtgcagcctcccaggggacaacttctgctgtcagccacccagaccagtcagccgcggagagcagcagcctgcagatgggacaccagtgctgagtgggacaggtgctggcttggccttgggatgtcacatgcataccctcccagtggacgtgaggattccaggggctcatgggatctgcctgctgcacccacaggtgtggcaggcgtgcttgtgggacacccgtttgacacggtcaaggtgagtctcatcgctgcttttttttcctcggcgcgtacattggagagaggctcacagggttggggtggctggaagcctgtttccgtgtacagccccaggtgggcagctgcttttacaccaggccgggttgaaccttcctcactgctttgtcctggcatctcccagctggggctgatccacatgctgggttcatggcc

SEQ ID NO: 19409 - DNA, 563 bp, Homo sapiens
  ENST00000556201
atttcgggactgactccaccccgtcccgcgcagccatccagcggggttggggctacggagccgaccccctactcggctggccttggagggcactgaaccactctggcgccgagtcacgccttggaacgccgccccttcctacgcggttttcacctgcccttgttcaccgcctcttcatctacttggatttggctcgaataaaccctcagctcccggccagcgctgagagccctggcggaagagtgggtagcggtggccttaagtattaaatctgtggcgtcggagcctgcttcttgggggagagactcgttgaaaagggagtgtgttggggaggtgttgtgcgctgaggggagttagaacttcccggtcggttacccagtgggaagctgcggggcacaaagcccagaatttgctgctaatcgctgggtgccctggagacagagggggcgtgtcctctgcggattccattctcaccttcccctcccgcttctgatctcgctgtttgctccacccttgctccccacccactatcagctccagcgggtgggggtgaagggctgtcc

SEQ ID NO: 19410 - DNA, 1050 bp, Homo sapiens
  ENST00000556844
gggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcgggggccatccagcggggttggggctacggagccgaccccctactcggctggccttggagggcactgaaccactctggcgccgagtcacgccttggaacgccgccccttcctacgcggttttgtgagctgttgggggcggaaggggggtggtgggtgggtcgggcgagccggtgtggggcaccttctccgaggcgcggtcgcggctctggggttcctcccatgcagttgtccccgggagggcccgggcgggcgtgcagtccaggctctcccatgccccgaccgtgggcgtcgggcacggcacttccctgttgggcctctggcttctctgcttttaccttgagggttaatttattcaccaggatttagatgtcgggggcgggggagggtggttggcggcgggagttgctgagagggccggccgcttatccctgtttggtcccacttttctcccagcacctgcccttgttcaccgcctcttcatctacttggatttggctcgaataaaccctcagctcccggccagcgctgagagccctggcggaagagtgggtagcggtggccttaagtattaaatctgtggcgtcggagcctgcttcttgggggagagactcgttgaaaagggagtgtgttggggaggtgttgtgcgctgaggggagttagaacttcccggtcggttacccagtgggaagctgcggggcacaaagcccagaatttgctgctaatcgctgggtgccctggagacagagggggcgtgtcctctgcggattccattctcaccttcccctcccgcttctgatctcgctgtttgctccacccttgctccccacc

SEQ ID NO: 19411 - DNA, 6087 bp, Homo sapiens
  ENST00000401722
accaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaaggtaaaccaaattaggctgattcttagaatgacagtaaaggaccaaagtgattgacagctgaaaacaattttcaggtacactaattctctttacacagatctgactttttttttttttgagacggagtttcactcttgttgcccagacgagtgtagtgtcgcgatctcgcctcacggcaacctctgcctcccaggttcaagcgattgttctgcctcagcctcccaagtagctgggatttcaggcatgtgccaccacgcccagctaattttgtatttttagtagagacggggtttccctgtgttggtcaggctggtctcgaacttccaacctcaggtgatccgcccgcctcagcctcccaaactgctgggattataggcatgagccaccgtgcccggctctgactttttacagaaaattgaactattttcagtctggtattttaagaaaggtactgcttgacagctgaactatatgaatgccactggggaaaaagcattccatcatacttagatacgagattggattgtaggtttaagcccatttttaaagagctcctagaaagtgaattagtttttgtgtttagattccccttaagtttgattaggaagtgtataaaagttcaatcttttgtaatgacagcccaccactggaaaaaaaacgaaaaacctagtgtaatatataacatgctgtttttcaaacactagattttacctagagtccttatgtgtaatacgtgggttggttaacagtccctacgtaaagcgtacagatggcctggagagaaaaactttttcagagattggagagaaatgttactacaaactcatggtaaggtcagtgaactcaatttagaagccagtgcagctagttgcatgttaacttctttatatcatcattgcctgaacttgttaaaggttccaacattttacctgtgctgcaggaaaaaaggaaaagttgtaggtacaaatttggaccaaactttaaaaaggtaaagtaggatgtcttctgaacccaaccaagtggtggctgtggtgcttagcagtatcaactgtatattatttcttgctatgttagcaaagcatccaaagatcaatggtgtatgataagcttttctgtgggtgaagaactcgggagtatcagactcttctggttctgagtctcatgaagcttttcacttctgagctgaaaggatgctctttgtgcttttcactattagtggtatagtctttcccgaaaatctctagcatggtggcttcagggcagctggacttaggtggtattttggggctccaggagagcttggcagagttggctttttaggacttatccttcaatgtcacataacatcacttttaccatgctcttggttacaacagtgatgtctcagaaaccaagtcccagattgaggaaaaaaggaacatagtctctacctcttcctgagaggaaagtcagtcaacgtgtaagaggagcagtagaaacgcattagtccagccaacgtgaaagtggaccgtagatctaaaacattttgggtatgcagttcagccagcccttactgaggcagttctgccaatcaggattcaagttttatttcctaagagttataataggttttatttgtgggcattgatacaaaatacgctgtgttcaagctatggagcctgccactgtagttactagagttacggttcaaagctatttctgagagaaagccacttcatcctcaaaacccaagaggcccacttaaagtgatgcgaattctcatttcaggtttttaaattatactaaaagattctagtaagaaaattttaatatgtatgtattggtgttctttttacatttcatttaatgaaatgtctactgtcaatacgataaagcagaacccagtggagtaagaatacacgaaactgccaggcacagtgggtcatgcctgtaaacccagcattctgggaggccgaggcgggtggatcacctgaggtcgggagttcaagaccagcctgaccaacatggagaaaccctgtctctactaaaaatacaaaattagctgcggtggtggtgcgtgcctgtaatcccagctactcaggaggctgaggcaggagaatcgcttgaacccgggaggcggaggttgtggtgagccaagattgcgccattgcactccagcctgggcaacaacagcgaaactctgtctcaaaaaaaaaaaatatatatatatatatatatatatgaagctgatagttgaattatgttgattcagggacaagatagcattgcatagtaacttccagtaggatcaaatattttgagagtggttaaaacgccaaggaatcctgattttatgaaattatgccttctgataggtgcaacaaaattgaacagaagagtaacagcttaactaaacctccattgtgtgaaagttttatgaaatgttttgacttttttttttttttccctagagaacagggttcttgctttgtcgcccaggctggagtacagccttgaactcctgggctcaagcgatcctcctgcctcagcctcccagttagctgacacaattgggatgtgccactacttgctcctgttttttcatagacgggtcctgctgttgctcaggctggtctcggattcctggcctcaagcaactttcctgccccagctcctaaagcggccagggttacaggtagccgccttgtctgtcccgtttcgaccatattttatttttgagaaggtcttgctctgtcgccagactggagtgcagtggcacgatgatagctcactgcagcctcgatctcccaagctcaagtgatcctcccacctcagcctcttgaataactgggactgcaagtgtggaccaccatgtctggctaatgttttttatttttagcagaaatgaggtcttgctatgttgccaaggctagtcttgaactcctgagctcaagcgagccttctgccttggccttccaaagggctgggattagagggctgagccaccacacttggccaaccatattttattttttatatttttattttatttgatccttgttctgaaaccataaagtgagtttaacatttctggctgggcacagtggctcatgcctgtaattctaacactttaggagaccaaggcaggaggatgccttgagcccaggagtttgagaccatcctggacaacataatgagaaaagaaaatacaaaaattaaggggtgtggtgacacatgcctgtagtctcaactatttgggaggctgaggcaggaggattgcttgagcccgagaggttgaggctacagtgagccatgtttacgccattgcagtccagcctgggcgacagagtgaaaccctgtctcaaaaaaaaagtaacatttctatatgatttttgggatcgacatgtccataatgttaatgaagcgcatagcagtcactagtaaattaggagttatacattgcttctatagcatcagaaattgtatatcaggccaggtgcaaaagctcactcctgaaatccaagcactttgggaggctgaggtgggcggattgcttgaggtcaggagttcaagaacagcctggccaacatgatgaaaccccaggtctctactaaaaatacaaaaattggtcaggcatggtggtgcatgcctgtaattccagctactcgggaggctgaggcaggagaattgcttgaacccgggaggcagaggttgcagtgagccaagattgtgccactgcactccagcctgggcgacagagccagactgtctgaggaagaaattgtatatcaggctgggcacagtggctcatacccgtaatcccagcactttgggaggcccaggctgggtatcacttgagcccaggagttggagaccagcctgggcaacaaagtgagacccctctctctacaaaaaataaattagccaggcatggtggcacgtgcctgtaatctcagctacttaggaagctgaaggaggatcgtctgagcccaggagtttgaggctgcaatgagctacaatcacacccctgcactccggcctgggcgacagagtgataacctgtctaaaaaaataaaaataaattgtataatcatattgcaattttctttgcattactgatgaggaaaaatctcaaagtaattgtaaaaaatcctggatatcacatagttgagaaacaaagttattttaaacttacaggactctgtagttcacagttgaacactgtggcttcctgaaatatcaaagaataatgtacattaataagccagctactatcggcatcttgtaaaaattaaaaaattaaacataaataaaagttcaaactatgtgttgaa

SEQ ID NO: 19412 - DNA, 1909 bp, Homo sapiens
  ENST00000188376
gtgtgcgtcacgccgacgacgcgcgaagggcacacatcttaggacccggaggacgtccggcctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatactt

SEQ ID NO: 19413 - DNA, 1359 bp, Homo sapiens
  ENST00000551917
aagggcacacatcttaggacccggaggacgtccggcctctgtgagccgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatg

SEQ ID NO: 19414 - DNA, 3236 bp, Homo sapiens
  ENST00000546766
cacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaaggtgagatcagaccctgcccaatacagtcgtgtggtctacttgtgggccgcccagcctttgaggcctggacccggcttggaggacagggaaggacgagtccagcccgctgcaccgtaggacggcgcccagttgcttgccctggggtatcggccttttccaccataggcgggtgtcagatccttggccttccctcaagggcgtggaagcgctgaggccctgtgtcccttcgtgacctccgtgtgcccgagggaagagaggccgtgactagctctttctccgccgtgagctcgcttggtcagcaaactaagtactgggtaaactctcctcccgaaactactgaccacccacagttctactaactatattacctgtcctttgatttgcccttagttttcttaaaaatagtcctttcctaagttttatatttgtcgacgccaggtcagtcatttttgcacttaattgtatatgagataactagatgtcctgttttcgtgcgactggaggaggcagcttgcagccctacataggcaatagaaaggagataattggtgggcgtccctttggtgtgattatctcttgggattcttggtggttgggcccagctttaacttagttgtgtgtgttttaaatcctagtgaagtatgtacatacagagaaacctgaaaaccgaattgtaggagtcctaagaatgttatctaccttgtgcctgtaaaatcgaaagatttttttctttaaatcattcatgtgcttctgttgtctttagtatggatagagtccttatttacactatctgtcgttcagtttaaaagttaaagctaacattatttgtgtattaaatgtatttgactgcaggaatttgtgcgtatccgtttttatgttacaggagttcttaagtggggatagtattggttagtggctgggataaactttgaagttgtttgcaagccttttacatgtcgagtgatctttctgagtttcgtttgtactctgaagtgtgctcttaccagtggttaataatttgaagtttgactttaattgtaaaagccgttaatgtagaaaacttttaaaaaaattaatatggcagaatacgagctattaatagtatcagatacagaaccctcataatttttaaatgatctgaatttggcagtgaatttttttttaagccacttaattgtggccaaagctattcagctgtgataatagtatctcacagggaaacattttctttcattccagtggccttagtcatctctgaagaaatacttacttgatttttttttttccaatcaaacagagcagtatagctgtgactatggatctggcagattctttatcctttgtggacttggaggaattattagctgtggcacaacacatacagcattggttcctctagatctggttaaatgcagaatgcaggtttgttttgcatgctggactagagcatattgaagcatgactgactgttaagttataagatatagtcatctaacaagctgtgtggaaacctaactgtccaggaggtaagtttatgaccagtaacatgagttttatattaaaatgcatggtgtgtcttctcttactacagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatactt

SEQ ID NO: 19415 - DNA, 550 bp, Homo sapiens
  ENST00000548046
acacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggaga

SEQ ID NO: 19416 - DNA, 1351 bp, Homo sapiens
  ENST00000552981
atcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 19417 - DNA, 580 bp, Homo sapiens
  ENST00000551265
ctctgtgagccgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaaggtgagatcagaccctgcccaatacagtcgtgtggtctacttgtgggccgcccagcctttgaggcctggacccggcttggaggacagggaaggacgagtccagcccgctgcaccgtaggacggcgcccagttgcttgccctggggtatcggccttttccaccataggcgggtgtcagatccttggccttccctcaagggcgtggaagcgctgaggccctgtgtcccttcgtgacctccgtgtgcccgagggaagagaggccgtgactagctctttctccgccgtgagctcgcttggtcagcaaactaagtactgggtaaactctcctcccgaaactactgaccacccacagttctactaactatattac

SEQ ID NO: 19418 - DNA, 756 bp, Homo sapiens
  ENST00000550695
ctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagagg

SEQ ID NO: 19419 - DNA, 556 bp, Homo sapiens
  ENST00000547534
ctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggtatgtaattaactttaaaattgaatgttccgagtgtt

SEQ ID NO: 19420 - DNA, 1285 bp, Homo sapiens
  ENST00000549338
cgcaacctttccaagggagtggttgtgtgatcgccatcttagggagtgaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttca

SEQ ID NO: 19421 - DNA, 1417 bp, Homo sapiens
  ENST00000551123
cgcaacctttccaagggagtggttgtgtgatcgccatcttagggaatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtttgttttgcatgctggactagagcatattgaagcatgactgactgttaagttataagatatagtcatctaacaagctgtgtggaaacctaactgtccaggaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatg

SEQ ID NO: 19422 - DNA, 1369 bp, Homo sapiens
  ENST00000548847
atcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaaga

SEQ ID NO: 19423 - DNA, 893 bp, Homo sapiens
  ENST00000547908
aagtttatgaccagtaacatgagttttatattaaaatgcatggtgtgtcttctcttactacagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggtatgtaattaactttaaaattgaatgttccgagtgtttaagactttccgagtgttcttagatttttgtctgtcttgccttattttagcactgaagaaaatggtcctacaaagtgagcaacttgttttaaatcgtatgcctgtgtcagcagagacaggttgataaatgtatttcattaaattacaattctccttttaatatactatcttgttttctaagtaagttggattttgagttttttagagaagggctctgggactcctttgcgtagttccggggcatggcatctagatattttttgaatattcatgttgttcacatagttacgtgttttgttaatgaggttatgagaccacatatatattccatatcatcgtgtgttactttataaaatgtctgaagcttagttgttttctagaactgtcacttcaattgaaaaccaacacaacagcaattcacatcccttccttgtgttttggattttaggagaatacttatctctggcgcacatcactatatttggctgcc

SEQ ID NO: 19424 - DNA, 517 bp, Homo sapiens
  ENST00000547444
aggtgcacgccaccatgcccgtccaattttttgtattttagtagagatggggtttcactgtgttgcccaggctggtcttgaactcctgagctcaggtaatccacctgcctcagcctcccaaagtgctgggattacagatgtgagccaccgtgcctggcaggaattactgtagttaccttttgtgtagttgctgaaatttattatggaacccaaacaaaaataatcatgagattaaatttttatgttagctgtttggtgcatttaattttttttttcttgttttaaataaaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctg

SEQ ID NO: 19425 - DNA, 722 bp, Homo sapiens
  ENST00000548480
caggactcgactcgtgtgcggacatttctgttaataatgacagtctctgatagatgagtgtatgcaactgtgtaaaacaagtctcttgatttcctagattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatga

SEQ ID NO: 19426 - DNA, 1018 bp, Homo sapiens
  ENST00000547869
attttagaactagaaaaatattattttaaaatcataaaaatgattattggctctgtgaagttttgtttttaactggcactgtatgggatcctttatcttttttcagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaaggtaaaccaaattaggctgattcttagaatgacagtaaaggaccaaagtgattgacagctgaaaacaattttcaggtacactaattctctttacacagatctg

SEQ ID NO: 19427 - DNA, 1678 bp, Homo sapiens
  ENST00000228318
gtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatactt

SEQ ID NO: 19428 - DNA, 3854 bp, Homo sapiens
  ENST00000302692
gcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtatacatttggcttgtgtcctcttttatgctcactatactatgaaggacttaagtaattcagataaacctgccctagaactgcagagaaaaatgataaagtgagaatacaacttgttttataatctgactttaagatcttgcactgctagacagggaagaagtgtcgcattttggctgggcactgtggctcacgcccgtaatcccagcactttgggaggccgaggcagatggatcacgtgaagtcaggagttccagaccagcctggccaacatggcgaaaccctgtctctactaaaaatacaaaaattagccggacgtgtgcctgtaatcccagctacttgggaggctgaggcaggagaatcacttgaaacccagggggcagaggttgcagcgagctgagatcacgtcacttcactccagcctggtcgacagagtgagactccatctcaaaaaaaaaaaaattgtgtcacattttggtggtggtgtgtggaccaggacaaacttcccagcaatttttcttctttgtacatttccaattacttgcagattgatcatctaagcgttcagactgctgagatgaatatatataactttctgagactcaatattttaagctataaaaaacttcctgaagttatccttttctccctactttgaaccaaaggcaagaatttttaaagaactgttttatcaatggcctggctcctggatatagttccggaagttaagaccagttgccttgttaagtgtgttgacagcacagctaccctgtttggctgtgaatccagaatgtgatgaagaacagtcattcccactgaggtctttagccctgttcttggacctctgctcttgcagaaaaggagcacaacgtaggactatggctcacccgtcagagagctcacattctgatagaaagcactgggattgtttaaatatcctagttcaacattaaaaaaaaaaaaaatttaatcccagcactttgggaggccaaggcgggcagatcacgaggtcaggagatcgagaccatcctggctaacacggtgaaaccccgtctctactaaaaaaatacaaaaaaattggccatgcgtggtggcgggcacccatagtcccagctactcgggaggctgaggcaggagaatggcgtgaacctgggaggcggagcttgcagtgagctgagatggcgccactgcactccagcctgggccacagagtgcgactccatctcaaaaaaaaaaaaaaaaccaggatgttacccccttggttttaaagcaaatttaataagggaacaaaaagatgatactaagaagaaggcaagtaaaacccctagtcttccattagctctttcactggaatttgagtatattgtacatgaaggttggttttcaatttgaacgtctagaaagatactcatttctaatacctatgcactgtagtttcaggtttacttgcagacaccctggtagggttaagaggaggatatttccaagttattttaaattgagtttacttttaactggggttcttgactctagtgtaattgctccaacaactacgtagaagtcaaaatgagtgactttagtgaagcttctgtactttacaatacatgacagtaatgctattccagaagttttgttttgttttgttttgagatggagtctcgctctgtctctcccaggctggagtgcagtggcacaatctcggctcactacagcctccacctcccggtttcaagcaattctcctgtcttagcctcctgagtagctgggactacaggcatgcgccaccacacctggctaattttgtatttttagtagagatggggtttcaccatgttggccaggctggtctcaaactcttgacctcaggtgatctacccgcctcggcctcccaaagtactgggattacaggagggagccaccatacctggcccgcgccgccccttcctttgttgttattgttgttttgagacaaggtatcactcgatcactgaagctggatacagtggcaagatcatagctcactgtaacctcaaactcctgggcacaagggatcctcgcatctcagcctcccaagtagcttggaccacaggaaagtaccaccatgcccagctaatgttttttcattttttgtgcagacgaggttttgctatgttgtccaggctggtctcagactactggccagaagcgatcttacctcctcagcctcccaaagcactggaattacagagtaacatctaattttaatattcacattcctattttaatattcatattcgatgatggcacttagcaacatcctcctatatccatattaaaacctgttttccaagattgtgtctaatatgaaggtgtaaaattgctttgttttcactccttcttgaatgaataaatttgatagtaaccaattataa

SEQ ID NO: 19429 - DNA, 2062 bp, Homo sapiens
  ENST00000381401
gcagcgggactgagccgcgcccacgtggaagccgccgcaggcttcgcgcggggccccccgggtgcacgcgggcaggggccggggtctcccgacgcacgaccccggagagtgttgaaagggtcggagctgcccggaggtcaagggtcaagggtcgggggtcggggcaccacatgtcgcacatcccggcggggtcgccgcggcctccgggagaaagcggacgacgcactcggagcgaactgggcatcagggtgggcttctgactccgcagctgccctcccgcccgctcgggtactggcagcggcctgaccttcacaaggtcaaggctgccgcggaacccccagcggcccctacggcgcatgggcggggcctggctcccggcatacctaggggtgcggggcgggacgtctccggggagcgcagccaatgggcgcggttcgctggagtgcggggcgggacgcagcgggattcccggcagccctcagaggcgaggcacgcaggctggtgtggggcggggcctggcggcgcagccaatgagcgcggcgcgaggaggcgcgggggcggagagtgggcgtggcgtcggcgtcttagcggctgcgcggtggctgctccgtcctttcggtccaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtc

SEQ ID NO: 19430 - DNA, 900 bp, Homo sapiens
  ENST00000475167
caggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcagggcgggatgtcccagcgcttcaagaggcccagggaggatcacctgagctcaggagtttgagagcagcttggtcatcgtagcaagactccatctctaaaagtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcg

SEQ ID NO: 19431 - DNA, 854 bp, Homo sapiens
  ENST00000484026
ctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcagcagggcgggatgtcccagcgcttcaagaggcccagggaggatcacctgagctcaggagtttgagagcagcttggtcatcgtagcaagactccatctctaaaagtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggatttcgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccg

SEQ ID NO: 19432 - DNA, 2602 bp, Homo sapiens
  ENST00000379083
gcacacagagcctgtagacctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgttggctttagtccacttcgaattctacgcaagcgcaacaaagctttgaggaaaatccgaaaactgcagaagcaaggcttgctacaagtgacaccaattttgcaagaatttatcaggatcaaggtagatgtgtatatcgttggaactgatgatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggaaaaagatggaaaaattgattttaccataaatacaaatggaggattacgtaatcgggtatatgaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatggttctagcatggcatatttttcacatatctagtatgaaattatataagtattctaaattttatatcttgtagctttatcaaagggtgaaaattattttgttcatacatatttttgtagcactgacagatttccatcctagtcactaccttcatgcataggtttagcagtatagtggcgccactgttttgaatctcataatttatacaggtcatattaatatatttccattaaaaaatcagttgtacagtgga

SEQ ID NO: 19433 - DNA, 2863 bp, Homo sapiens
  ENST00000340010
cctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgttggctttagtccacttcgaattctacgcaagcgcaacaaagctttgaggaaaatccgaaaactgcagaagcaaggcttgctacaagtgacaccaaaaggatttatatgtactgttgacaccataaaagattctgacgaagagctggacaacaatcagatagaagtactggaccagccaatcaataccacagacctgcctttccacattgactggaatgatgatcttcctctcaacattgaggtccccaaaatcagcctccacagcctcattcttgacttttcagcagtgtcctttcttgatgtttcttcagtgaggggccttaaatcgattttgcaagaatttatcaggatcaaggtagatgtgtatatcgttggaactgatgatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggaaaaagatggaaaaattgattttaccataaatacaaatggaggattacgtaatcgggtatatgaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatggttctagcatggcatatttttcacatatctagtatgaaattatataagtattctaaattttatatcttgtagctttatcaaagggtgaaaattattttgttcatacatatttttgtagcactgacagatttccatcctagtcactaccttcatgcataggtttagcagtatagtggcgccactgttttgaatctcataatttatacaggtcatattaatatatttccattaaaaaatcagttgtaca

SEQ ID NO: 19434 - DNA, 646 bp, Homo sapiens
  ENST00000469651
taacaaacatacatgaatgatttacttggtgtttttctccctacagtccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgtaaggtttggggttatttaatttttttccttgtaatcttactgaattctgggaatgtcattgttctgtaaggtcattgttgagactgggttgtgtcacatatgttgaggtggggttgtgtcagtattttttgtcccacgtcccagaacagatgaaactaccttatggggagtttgttaataggttgggaaataagcctcttcagatgacatctaatatagaagaatccttttctcaaattctgatgtagagtaaaagaaatttaccaagttttgggctgctagcttttagtagatgtcatcctacagattttctttgggcatcaacttcagaaacaatgaaggagcatttaatatttgaccacatcctcaaagagattcagtataacagttgtaaatgaatagttaatactgaataacaatacatactgagtgtcc

SEQ ID NO: 19435 - DNA, 556 bp, Homo sapiens
  ENST00000468551
tttataattgtaggtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttcta

SEQ ID NO: 19436 - DNA, 552 bp, Homo sapiens
  ENST00000453332
gcacacagagcctgtagacctgagtggatggacactgcctcttagaactagaacttagaactttatcttgaaaatgtaccactgttgcagaagctcctcacagagcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggc

SEQ ID NO: 19437 - DNA, 2474 bp, Homo sapiens
  ENST00000339444
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 19438 - DNA, 1404 bp, Homo sapiens
  ENST00000356767
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctaggctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 19439 - DNA, 1947 bp, Homo sapiens
  ENST00000393735
aggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagctttcatacagagatgaccagaagatggagaccgtaggggaaatgccgtgtaatccaagcagttcaggctttggggccaggtggacagggtttgaatgccagctctggaatctgttagtggggtgacctcagccaagtcacttaacacttctgaactttgttttctcttttgtgaaataaagaaaaaatgaatctac

SEQ ID NO: 19440 - DNA, 2324 bp, Homo sapiens
  ENST00000445809
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatgcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 19441 - DNA, 2242 bp, Homo sapiens
  ENST00000454864
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 19442 - DNA, 2498 bp, Homo sapiens
  ENST00000393730
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 19443 - DNA, 2689 bp, Homo sapiens
  ENST00000306312
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaagataaa

SEQ ID NO: 19444 - DNA, 2374 bp, Homo sapiens
  ENST00000423416
tctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacg

SEQ ID NO: 19445 - DNA, 2370 bp, Homo sapiens
  ENST00000456463
tcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatgcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaa

SEQ ID NO: 19446 - DNA, 2422 bp, Homo sapiens
  ENST00000393729
tcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaa

SEQ ID NO: 19447 - DNA, 2270 bp, Homo sapiens
  ENST00000393727
agagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcaacacaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggat

SEQ ID NO: 19448 - DNA, 2174 bp, Homo sapiens
  ENST00000393723
agagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcaacacaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggat

SEQ ID NO: 19449 - DNA, 2098 bp, Homo sapiens
  ENST00000487407
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatgcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagaggtgagtgcccagattggaatgggtgtgaatgtcccggcagagatgacaatgttgactttaggtgtagaccaaagtttaagttggtagaagtggagccctttgatgatttctagttagcgtgagagggagctataacactcatgtagcctgttgactagatgaacaaaatgccaatttaaaaattccatataattttgccaaatgctcttctatgtcacaatttatgctcccatcaatggttatgttaaaagagcctaatttccatcattgtttctgccattcctggtctagtgctatgctggtttatttatcctcttgtgatttgttttggcaccaagtactgacatgagtttcaatgacatgaagcaaactctgacaccaagttatcgtatgcattccttccactgtcatttcctccaccctgaaccactttcccttgttatctcttctccctagtaggaagctgagcccactagggaaagtat

SEQ ID NO: 19450 - DNA, 2588 bp, Homo sapiens
  ENST00000432958
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccagaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcagatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttcaaag

SEQ ID NO: 19451 - DNA, 2686 bp, Homo sapiens
  ENST00000354356
acctggaggcagcgcgcgcgtcgaagaggcagcggctgtggagcgcggcggggcggctccgcccagggcagcccgggctgggccaaggagcgagctctcccttctcctgctctcagcctcagtgatcaaggcttcagtgaactgcactggagctcccagcgggggatcttgtcccctgtcccgacttttgtgctgcacattggatctggtgacactcaggaaatgcttgtctccggctgttaaggaataatttcagagtactatggatcatgctgaagaaaatgaaatccttgcagcaacccagaggtactatgtggaaaggcctatctttagtcatccggtcctccaggaaagactacacacaaaggacaaggttcctgattccattgcggataagctgaaacaggcattcacatgtactcctaaaaaaataagaaatatcatttatatgttcctacccataactaaatggctgccagcatacaaattcaaggaatatgtgttgggtgacttggtctcaggcataagcacaggggtgcttcagcttcctcaaggcttagcctttgcaatgctggcagctgtgcctccaatatttggcctgtactcttcattttaccctgttatcatgtattgttttcttggaacctccagacacatatccataggtccttttgctgttattagcctgatgattggtggtgtagctgttcgattagtaccagatgatatagtcattccaggaggagtaaatgcaaccaatggcacagaggccagagatgccttgagagtgaaagtcgccatgtctgtgaccttactttcaggaatcattcagttttgcctaggtgtctgtaggtttggatttgtggccatatatctcacagagcctctggtccgtgggtttaccaccgcagcagctgtgcatgtcttcacctccatgttaaaatatctgtttggagttaaaacaaagcggtacagtggaatcttttccgtggtgtatagtacagttgctgtgttgcagaatgttaaaaacctcaacgtgtgttccctaggcgtcgggctgatggtttttggtttgctgttgggtggcaaggagtttaatgagagatttaaagagaaattgccggcgcctattcctttagagttctttgcggtcgtaatgggaactggcatttcagctgggtttaacttgaaagaatcatacaatgtggatgtcgttggaacacttcctctagggctgctacctccagccaatccggacaccagcctcttccaccttgtgtacgtagatgccattgccatagccatcgttggattttcagtgaccatctccatggccaagaccttagcaaataaacatggctaccaggttgacggcaatcaggagctcattgccctgggactgtgcaattccattggctcactcttccagaccttttcaatttcatgctccttgtctcgaagccttgttcaggagggaaccggtgggaagacacagcttgcaggttgtttggcctcattaatgattctgctggtcatattagcaactggattcctctttgaatcattgccccaggctgtgctgtcggccattgtgattgtcaacctgaagggaatgtttatgcagttctcagatctcccctttttctggagaaccagcaaaatagagctgaccatctggcttaccacttttgtgtcctccttgttcctgggattggactatggtttgatcactgctgtgatcattgctctgctgactgtgatttacagaacacagagtccaagctacaaagtccttggaaagcttcctgaaactgatgtgtatattgatatagacgcatatgaggaggtgaaagaaattcctggaataaaaatatttcaaataaatgcaccaatttactatgcaaatagcgacttgtatagcaatgcattaaaacgaaagactggagtgaacccagcagtcatcatgggagcaaggagaaaggccatgcggaagtacgctaaggaagtcggaaatgcaaatatggccaacgcaactgttgtcaaagcaacacaggatgcagaagtagatggagaggatgctaccaagcctgaagaagaggatggtgaagtaaaatatcccccaatagtgatcaaaagcacatttcctgaggaaatgcaaagatttatgcccccaggggataacgtccacactgtcattttggatttcactcaagtcaattttattgattctgttggagtgaaaactctggcagggattgtaaaagaatatggagacgtcggtatatatgtatacttagcaggatgcagtgcacaagttgtgaatgacctcactcggaatagattttttgaaaatcctgccctatgggagctgctgttccacagcattcatgatgcagttttaggcagccaacttagagaggcacttgctgaacaggaagcctcggctcccccttcccaggaggacttggagcccaatgccactcctgccactcctgaggcatagatgaggacctcaccctaggatggggttataagcctctcatgaagttcataatttacacgttttaaatactagacgctagatttttttttctaagggtgaatactagtagtccaggcttgatttggagggtgaatgacgcctagcaagatgtattgtacttgtgtttttttaattgaatacttc

SEQ ID NO: 19452 - DNA, 3653 bp, Homo sapiens
  ENST00000490799
tgttcaggacacgaggcctggcaccaaataggccctcgatcaagaatagcaaaacctcggagagagaaggagccttggtatacaggtttaccaaataccaaggggatcccacgactcaggtatgaggagggcgacccaggtaccactttcctggctccctagcccagctgctcatgctcctcttcctcgtcccctcccccactctcatctcctcagcccgcccggaacgcccgcgggctaggccacaacggctcgggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaca

SEQ ID NO: 19453 - DNA, 2876 bp, Homo sapiens
  ENST00000466805
ctttctttctttttgatggcactggagcagagagaaactaaagcaggaaaatgggaagtgattatctttgtgttttttaagatgaagctccactgaagctgctagatgggcagttacccaagcagcaaacaggagagtgaggggtgggaaatttacttacatgggaagtagggctgacactgaggagctactagggcttttctttccttatatttattttttttttgagatggagtctcactctgtcgccaggctggagtgcagtggcgtgatcttggctcactgcaatctccgtctcccgggttcaagcgattctcctctctcagcctcccaagtagctggaattacaggcacacaccaccaagcccagctaatttttgtatttttagtagagacggggtttcaccatgttggccaggatggtctccatcttttgaccttgtgatctgccggcctcagcctcccaatgtgctaggattacaggtgtgagccaccgcacccggccaactacggcttttctaaattgtgcaaggagaggttaaacttaggaggagatgcaaatcagattttaggagaattcagattcatagcacagagcagtggcagtaaagattcaaatgcccaggacaacgtggagcttttcagggagcatctttccattcatttagggagtatttattgagtacctagtatgtgtttagcactttgataagacttgaaaatgtcagttcaacaaaaatacacttggactgaactcaactccttttaagaaaaattgacatgcttctcaccaagcagaaggcctcagttgcagacagggaccaatacgttcctgatggtttctctccaactggctctgtctcctcagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagt

SEQ ID NO: 19454 - DNA, 3144 bp, Homo sapiens
  ENST00000394602
gctgggagacgcctgggcgccgggggctgcaggtcccagggcgggggctgcgtccgtcaccggcaggtacccaggtatgccgcagagccaggcacgccgtgggcactcagtcagtatctgtggaatgaatgaatgatggtcgtccctgggagcttatctctgaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactcta

SEQ ID NO: 19455 - DNA, 3463 bp, Homo sapiens
  ENST00000355574
ggtatccgcgtccgcagcgccgccagccaggcgagagccgtgtgggatcccagcgcccgcactcccgcccccgccaaggagccaggtgagccgctgctgggagacgcctgggcgccgggggctgcaggtcccagggcgggggctgcgtccgtcaccggcaggtacccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactct

SEQ ID NO: 19456 - DNA, 2104 bp, Homo sapiens
  ENST00000465492
tttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacaggtaagtactgaggaggccttggcaggagctctgatccccctcctaccatcccaaccccaccctgatcctgattgaattctgttagtcactgatcagctgctatgagactgctaggccaccagagccttggacaccaaaggcagtacaatataaggtcaatcaaaataaaaagagaatgaaccaattcttttttcttttttcttttttgagatggagcctcactctgttgcccaggctggagtgcagtggcacaatcttggctcactgcaacctccacctcccaggttcaagagattctcctgcctcagcctcctgaatagctggaactacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctg

SEQ ID NO: 19457 - DNA, 2989 bp, Homo sapiens
  ENST00000486155
atgttcaggacacgaggcctggcaccaaataggccctcgatcaagaatagcaaaacctcggagagagaaggagccttggtatacaggtttaccaaataccaaggggatcccacgactcaggtatgaggagggcgacccaggtaccactttcctggctccctagcccagctgctcatgctcctcttcctcgtcccctcccccactctcatctcctcagcccgcccggaacgcccgcgggctaggccacaacggctcgggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacaggtactttgtctcaggtaataggaggttaacaaggcaaggtaagccaactctgacctaaaggcaagtgcatttcctttcagagctaagattcttctcctgggtcaaatccctaacaccaacatttatagaagcatcaatgattatcgggaggtaagaatccaaatgggtcccatttctctgcctaagggatagagtgggccccacctcatgcttagtttttctacaaaatcccttgccattgtttcctgcactgcagatacacatttacaaaggagggggatgtgatgtacactggtagagatgggttctttgtttttatttttttttttggagacagagtcttgctctgtcacccaagctggacagtacagtgcagtggcttgatcttggcttactgcaacctccacctgccaggttcaagcaattctcctgcctcagcctccccagtagctgggattacaggcgtgccccatcatacctggctaattttttgtattttagtaaagacagggtctcaccatgttgcccaggctggtcttggactcctgagctcagtcaatctgcttgcctcagccttctagagtgctaggattacaggcatgactcaacacacccagccaagacgggttcttaagtagctaaattcttatagtattgcagccagttaaagatcatttgtaaatgtactttaaggagagtttggccaagaaaaaggaaatgaagggagaaagaagacagcaggaaaagcagagggtgaaaatgggaggaaataattttctagttcttgtctctaataaagaagaatacaggctgggtgtgttggctcacacctgtaattccagcactttgggaggccaggcatttgagaccagcgtggccaacatggtgaaaccccgtatctactaaaaatacaaaaattagcagggcgtgatggcaggtgcctgtaatcccagctactcaagaggctgaggcaggagaattgcttgaacccgagaggcggaggttgcagtgagccaagatcgcgccattgcactccagcctgggcaacagagtgagactctgtctc

SEQ ID NO: 19458 - DNA, 740 bp, Homo sapiens
  ENST00000469847
tggtatacaggtttaccaaataccaaggggatcccacgactcagcccgcccggaacgcccgcgggctaggccacaacggctcgggaaccgccgccggtatccgcgtccgcagcgccgccagccaggcgagagccgtgtgggatcccagcgcccgcactcccgcccccgccaaggagccaggtgagccgctgctgggagacgcctgggcgccgggggctgcaggtcccagggcgggggctgcgtccgtcaccggcaggtacccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatc

SEQ ID NO: 19459 - DNA, 582 bp, Homo sapiens
  ENST00000480663
gtgcactgctgtatgttcaggacacgaggcctggcaccaaataggccctcgatcaagaatagcaaaacctcggagagagaaggagccttggtatacaggtttaccaaataccaaggggatcccacgactcagcccgcccggaacgcccgcgggctaggccacaacggctcgggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggcctt

SEQ ID NO: 19460 - DNA, 811 bp, Homo sapiens
  ENST00000508645
ccgtgcgctccgaagacggatattggaaagctgcaaaagtcaccagaaagaaacagggctgccttagtaaagtacagaggtgaagtggagcaagatggcagaatagcaagctcctttgatggccatccgcacaaatgtctacacagaaaaagcaccttcacaagaaccaaaaatcagcctgttttgtgcaacttccaagtcaagattatgaacattttcagactttttgcaagacagaattcaatggattaacaatcagccttatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgat

SEQ ID NO: 19461 - DNA, 3219 bp, Homo sapiens
  ENST00000262462
gggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttact

SEQ ID NO: 19462 - DNA, 2616 bp, Homo sapiens
  ENST00000395266
gacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaatatttta

SEQ ID NO: 19463 - DNA, 2294 bp, Homo sapiens
  ENST00000506176
gagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaa

SEQ ID NO: 19464 - DNA, 4389 bp, Homo sapiens
  ENST00000359271
ggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaa

SEQ ID NO: 19465 - DNA, 497 bp, Homo sapiens
  ENST00000486000
cctcagcgcccccagcacgccgccgagtcccgctcgccatggcgcccactcgggcccaggcactctcccgggcgccctgatccgacagccccaggcaagtgcagctgttcctggtctgcagatgaagaaatggaggctccgaaagaagcaaagcagttcatcgattcgctgagcgcggttgtgccccaggcgctgttgtgggcctggggacgctgtcgcgaacgaaactgcgaacaaaacagacgaaccccctcctctggacgtgattctgcagagaggggacagagaaggagattctaacacagcattggggtgggacgcgtggggaatggctttgttgccactcgggactagggctctatttttctctctgcattcagaagcctcgaaggatcagtcgttgattcttgagtgagcacctactacgtgccagacattgatataggggttagagcttcagcaatgaacaaaatagacaataaacctctctctcatgg

SEQ ID NO: 19466 - DNA, 586 bp, Homo sapiens
  ENST00000611837
agatgtgtatacctggaggctccttggggaggtggcacaggacctgggactgaagagggagagtagaggaacaaggggaccctttccttggggaacaaggacagtgcacgtaggaggcccagcacgtgcagtggtggagcggcatgaaagcatacagccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgt

SEQ ID NO: 19467 - DNA, 7003 bp, Homo sapiens
  ENST00000280871
ctgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtactacagtgcaaccattctgcagatgtctggtgttgaagatgatagacttgcaatatggctggcttcagttacagccttcacaaatttcattttcacacttgtgggagtctggcttgttgagaaggtgggccgcagaaagcttacctttggtagtttagcaggtaccaccgtagcactcattattcttgccttgggatttgtgctatcagcccaagtttccccacgcatcacttttaagccaatagctccgtcaggtcagaacgccacttgcacaagatacagttactgtaatgaatgtatgttggatccagactgcggtttctgctacaagatgaacaaatcaactgtcattgactcctcctgtgttccagttaataaagcatctacaaatgaggcagcctggggcaggtgtgaaaatgaaaccaagttcaaaacagaagatatattttgggcttacaatttctgccctactccatactcctggactgcacttctgggccttattttatatcttgtcttctttgcacctggaatgggaccaatgccttggactgtgaattctgaaatatatcccctttgggcaagaagtacaggaaatgcatgttcatctggaataaactggattttcaatgtcctggtttcactaacatttttacacacagcagagtatcttacatactatggagctttcttcctctatgctggatttgctgctgtgggactccttttcatctatggctgtcttcctgagaccaaaggcaaaaaattagaggaaattgaatcactctttgacaacaggctatgtacatgtggcacttcagattctgatgaagggagatatattgaatatattcgggtaaagggaagtaactatcatctttctgacaatgatgcttctgatgtggaataattttcagctgctcatatatttagttatttaaacaaactggggggagaagaacagcaattggtgacttcactgccctgcttctaatctggttctttccacagcctagttttgattgacttcatattctagaatacttgattaggaggaagatacaaccatgatgactttttttttccacaaggaacaatattttaaaaaatatttacagagattttaatctaataattcttaagcaaatgtgtgtaatgccttcctgaaatagtctaaaatgaatattgtacccagtgacttcagtggtatccttttttcctaagaccatttataattattagtggcaacagagtcagtgctaatctagccaaattacatatgtataatatatttataaaggattctgggagatggtccaagggtgttctgtgtcaaaagatggcctattggccctcagttttcctacagagtagtggcttatctctgatcagctgttacaaactaaattccatgtaagctttcatcaacaaattccaaagtgcctcctacaagggcacagctgtccgtatctcctttggattccatatttttgtttctctccaattcagatattgggagttcttcagatactgactctgcacactatcttttgaacattatgaaaatataatctgtcgggttgttttcatacttcttttttttgcatcagtgataaggcatacatttgcgcagatgagctaggaagttttgagaagtaccttttatgttcagaaagtaacagattaaaggtttttatgggttccaaattggttagtcacttaggtatgcaattataaatgcaaaatagtgccagatctttaactgtatatcagggtcagtttttgttcatgcccaaatcactacaccttcctcattggccttggagtcctactatttcgtgccttcatttgtgttacatacatagctgcaagcaaaccatttttcccctttcttttattcaaacaataatttttgaaacaaaaaagaggaaggaaatcagtggcagaaataatcctgctgttattggtgtttgtttaataaaaataatgggacttttttcttaactttttattagctcttcctaagggaaatgtcacatattattatttaattgtacttgtctttttttactttaagagcataaactcgtttttattttgcacacttttctcattttcctgagaatttaccagaaaaaaaaaagatacatagatttgtctctgtgtttttcttattcttggcttagtttttccttcttgtgtaaaaattgagattgcctattggaacagataattggttctaatatagcacgtctataagaaatgcaggcttaattatatttccacaatgtctttccaaggtattcattggtttttatggtaattcatcactgaactcttaatttttgcttttctattaagaactatatagtatgtacaaaattacttgatcacaaaattacttgctagttccaggaaaaatatgaatgaatcttctgtggccagttaggaatacatcagtttgatgcatttttaaatggctctaaacatctaataaggtactgtatttggagagaaaaggtggctatctccatattcaaaatatttcttccagtctccaagatactctattcttttaatgtctggcttgttcctatcacagttatcaagctgagaatacagctgaggaagttcattctctaagtcaccagaggtataatatgtgcttaaactgtcaatttagtgccctaaaaatccattaaccaaaaacaaaaacgttttctccctttggtcatttcatataataaaaaaaattaatattttatagaggttttttccttgaattaggtgctttaacaattgatttccaagggaatattagtattgattttttcctcagaaaagcagatatgatttaatagggaaaattattattctattgatatttcttatctcataagaaatttcttatctaatattttacacaggtaaattgaagtgaaaaataagctactatatggtacaatcaaaatataataaggagaaaaagtagaccaataaagtgctctctaaaaatttattttttggacttaatcaaaataattgcctcaatccttctctttattgtatatgtagccttaactaactatatacttataaactcagctgggctgatgcacagtaactttattaaaggagaaactggactcttgttatttcctaaagcagaacatggcctgttctccctgatataagaaaacaatgttttcaactttataaccataaatgcacataataacagggaaaattagccacagttctcctcccctactcccctgagcccctactttaaaggactatttgttatttatatagtgttaaagataatattccatatctttgaagtataagacagagaggcacagtataagaattatttataactttttagaaacaattacttgaaaaggaaccttatacaattagggtattatttttagatttggtgaacatttatagtatattaaaaattaaatgtttaaattttgcaggtttttttatattaggcaccttttaagttcccagcatatttggctaccactatcaacttggaaacattccatttgtagtatcatcaaatatatattttgtaggacaatttatatatgatgtgatttgacctaccatattaaagcagacacagattacgtatcatgctttcaaccaaaattacagacttcctttgaaacatgctgcagatttgatagaggtatattatgtcttaggaaaatacaatgaagaaggtccaaatccctattgaggctggatgtctgatctgcactagacttaagaggatatatcatttcatctgcatataaacacatagggctgaatgtgatgtcaaaagggtttgccgttaataattttcttcaatgtaaacattcctaataattttgattgttgctccttagtcaatcatttcccaaaacatgattatttttaatatatgtaaaatatttaaataataaataataaaaggtaatgtgtccattttaaattttgttcccagccatacacagtagttccctgatacaaaatgctatgagaataccgactattttttcataatttaattttaccactgaacctgattttagtacataagagtctaaatattaagttattcactctaaaaggggaaatcagtaaaagcaaggaatttatgaaatttttgctgtaatttcagtatctgttatacaggggaagaatgatcaggaaaaatataagctgacaacttacccttttgctttttaacaacaaaataatattgaaaatatattagaataactcacagatccagaagttggtggaaatggaagaatgttttagaaaataccatccatatgtttatctaagaaagtctcagaatttagtgacactaatacagttcataaatactgtaatacagtggagagagttggaatgttattttggttttatttcatcagcacaattattaaaaacaacaaaattaatgagacgttttgttataatcagatttttttttaccatattgcaagttataaaatgtcaacttatactaagtacctaacaactgacttttattcacttgttgtgacaagtttttaattaccaaattaagaccttttcagtatctatgagtaaaagaaatagatgattatatcagaccaggagcagagaatttataatatgtgctttatagcaaaatgtattaaattgtggttaaaatttatagctcatatgtagctgctgccaataagaaggctcagaattgttctgtggattaatttttacatcctgttttctgtcacttttaccaatcttcttggcctcatgtacaataatgtaaagccaatttgatgaaatggttcaggttgtagcagtctataaattgtcggtacattcagctcttctaggtgagcaatactgctgctatttttctagaaatagcaatcatttaaaaatgccaaatagctaactgctaccaactctttcttgtatcttgtctctttagagaaggaaatttttgtgtgccagtaatcatcaaagaggtgttttataagagtgttgatgttcagaagttcatgaaagtattttatccgtataatttgctagtgagctaaaacaatataatttatgtaaatctttatatgtacaaaatatatagtctgttgtacttgagtaatttggtctatggaattttaaatgccttcatttagcagtaatattcacatttttattttagacagttaagttcatgtgtttgattttgtcatgtcagcataaatgagaaaaagaagtggatcatgcagctaatgagtaaccaacattttgtaaagttttaaagttttagcaaacaacattattccatctcatttaaaggttaaaaaagaagagacaactctagccaaagtagaaatttatattctacacgtccaaactgtctcctagcagcttttggactatatatcacttgatgttaaagtatcttttatttgtaataaatattcaaatttctatttagaagctctaatgtatacctagattaaatcaaatcacagttttatgcttttaaaatatatgtatttcaaactgtatattttaatttctgagtgcatgttatatagtatttaatacttcagatgtcttggcaaattcaatataagtatttattcccacaagcgatatatgggatatctcttaaaaattatgaatatgtaccatttccttcaaagtcatcctagcctatgctgtatcaaaagtattgtatattttatggagatttagtgatatacatgtaaatgttttttaagttattttattgaagttcaatctttacataaaattaaaatctttttttaaaaaaagtgtcagtgccagaactgtaaatgaaaataatcaaataaaagttaaaataattcattactcattaa

SEQ ID NO: 19468 - DNA, 1026 bp, Homo sapiens
  ENST00000465517
tcacaaatttcattttcacacttgtgggagtctggcttgttgagaaggtgggccgcagaaagcttacctttggtagtttagcaggtaccaccgtagcactcattattcttgccttgggatttgtgctatcagcccaagtttccccacgcatcacttttaagccaatagctccgtcaggtcagaacgccacttgcacaagatacagttactgtaatgaatgtatgttggatccagactgcggtttctgctacaagatgaacaaatcaactgtcattgactcctcctgtgttccagttaataaagcatctacaaatgaggcagcctggggcaggtatatcactcattttaccatacgaatatataataatatttcaaaacgaggcttatgtttaagttttcagagtgcttgcacttatagcagttcttttaaactggccttcataactacattactttgcagcatatactggtgatagtggatgcaaagcattgcaattgtgtgtttcacacagagtagaaagcactcaggcctagacttttggagacccagatttctctaataaggtataggagtttggatctttagttttaggcagctattcacaaatactgccaaggcaatttctcccactgcatattgtttaattgcactgtatttccaaactcccaagcttttaaatgaaagaaaactgtaaagtcaaaatgaattactatcacgttaggttgggcacagtgcatcacgactgtaatcccagcactttgggaggctgaggcaggcagatcacttgaggtcaggagttcgagaccaccctggccaacatggtgaaaccccacctctacaaaaatacaaaaattagctgagagtggtggcacatgcctgtaatcccagctgctcaggaggctgaggcaggagaaaggagaatcacttgaacctgggagatagagattgcagtgagctgagatcaaaccactgcactccagcctagacaacagagcaagactctgcctcaaaaaaaagaaaaaaaa

SEQ ID NO: 19469 - DNA, 436 bp, Homo sapiens
  ENST00000505338
gtgcattggttaattcaataaatatatattggtgatccaccctgcagggggctgcatgctgttctacagatacagagttgtctctcagatccaagcctccttcagctcaaagtgacttccaaagttgctgtggccaaaagagggagaaatcgaagagaccagccagctctcacctggctcagcgcatgtcactttccttggccaaaacaagtcccaaggccccaagcttactgcacaagagagtggaaaatgcagagaagcacatggaatccagtatatggtgagcaccagttgtctctgccaacatgacggtaactcttttcatttttcagttactgtaatgaatgtatgttggatccagactgcggtttctgctacaagatgaacaaatcaactgtcattgactcctcctgtgttccagttaataaagcatcta

SEQ ID NO: 19470 - DNA, 3082 bp, Homo sapiens
  ENST00000380858
cgcctcccgcccgctccgcagcgccagctcggcaggcgcggggcgtgagtgtggagtgagacccgccgggctccaactccgcagcgtcggagcgcggcgggcagcaactttctccccggagcggccgtggcggcggctgctgccgtggcagccggagcggaagccgggaggaagaaagcggcggcagcggcggttgctcccgccggctcgggctgtctagctcgccgagactgccggcccgcggagccgcgtccccccgggcagccccgggcccctgccctatgtcccgcaaggcaagcgagaatgtggagtacacgctgcggagcctgagcagcctgatgggcgagcggcgcaggaagcagccggagccggacgcggcgagcgcggccggggagtgcagcctcctggctgccgccgaatcgagcaccagcctgcagagcgcgggcgcgggcggcggcggcgtcggggacctggagcgcgcggcgcggcggcagttccagcaggacgagacccccgccttcgtgtacgtggtggccgtcttctccgcgctgggcggcttcctgtttggctatgacaccggggtggtgtcaggggccatgctgctgctcaagcggcagctcagtctggacgcgctgtggcaggagctgctggtgtccagcacggtgggggcggctgccgtctcggcgctggccggaggcgccctcaacggcgtcttcggccgccgcgctgccatcctcctggccagtgccctcttcaccgccggctccgcggtgctggctgcggccaacaacaaggagacactgctcgccggccgcctggtcgtgggactcggcatcggcattgcttctatgacagtgccagtgtacattgcggaggtctcaccacccaatttaagaggccgattagtcaccattaataccctcttcatcacaggagggcagttctttgcaagtgttgttgatggagccttcagttatctccagaaggatggatggaggtacatgttgggacttgcagcagttccggcggttatacagttttttggctttctctttttgcctgaaagccctcgatggcttattcagaaaggacagactcagaaggcccgtagaattttatctcagatgcgtggtaaccagaccattgatgaggaatatgatagcatcaaaaacaacattgaagaggaggaaaaagaggttggctcagctggacctgtgatctgcagaatgctgagttatcccccaactcgccgagctttaattgtgggttgtggcctacaaatgttccagcagctctcaggcattaacaccatcatgtatgtatttctttctggctttttactgaaaagattgtgaaaggattattttatgtgaaatagtgaaaagtatttcatgtaaatactagactcagtgatttgttctgattaaatgtatgaattctccttttgggagatactgactttacaattttttaattccagtaatttgttactagataaaggtgatttattttgtttgttatatgattggctttatttgattccataaaatttctcttttacgccatccaatacctccttgtattctgagcttaaatgtgtcattttttctaagccatttcttgatgctggttggaaagcaaaatagaaggaaatcacctggcattgccagagattatgggcacacagataactaattcatttctttttggtgcagtctactacagtgcaatgtgataaggacattagtagaagtacgtttattataaccagagtatggtagaggggagattgagtgggaaggagagtgaggaatacagaaaaattccctgttctctaattttaagagtaattcccaaagctgtatgtgtgctgagggtgggaaggactaaatattaagggctctactaggtttccctcattcagtattaaacccatttttgagggcctctgttgcactagacctacagcagtaactaaaatagacctgggtcttgtcctcatggatgtacaggctggtagaggaagcacacattaaataaactcacagttaaatataagatttcaaactatgataagggccatacaggactctctcaattctctacagagtagacttttaagatcctaaatcataaaatacagtttagagaaggttatgtgctttcccagggcacatattgttagattaaaagctgccacatcttagaagtcctccccactccctgcctattgattgaatttttttcattaagaaaatacaaattatgtaaaattaaattttctttggtaaaccatttgtatttgagactcttgattttttttaattacttgagatatgatgagttatttagtgactgtttgagaagagtgaattgattaaaatatttttaaaaaagaaggattaggacccaatgagccagtatattaaatcaagatttgttgagaaactccattttctatacattcacacactttgtggatttgactttaatcataatccctgttgaacttcaactttcgagactacatgttcaatattttgttctctcctgcttctctctgacattaactttcattttttctcacctttaccagctctattaaggcccatctgttggtctagtgccaggcacgtttgattgcttgttctctgaatttggcacatcatgacttgttctgagatgtgtccaccttctgcagtctggtggaagtatagaattgcagctaggctaggaccaagcatcaaataattaaatccattaataatcctatgtgaattcgttagttgaccaacctaatatttgttctggttttgaaaatatgttttgtttgttatgctttttttcctaagcatttaaacttgacaagtataaaagcatagaaagtgaaggatttttcttgtactttttttgttttcacttaaaactggtatcacaaacagagccaactctagtttatgggtagtgactggggccagtgtattcctagtttgaaatgactgtcataatccattagcagtagctagtgtaaattgagctgattgatgctgtcaaattttaataaaacattcatttctccaaa

SEQ ID NO: 19471 - DNA, 3915 bp, Homo sapiens
  ENST00000075120
gtggggtggggtggggctgggggcttgtcgccctttcaggctccaccctttgcggagattataaatagtcatgatcccagcgagacccagagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagatcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttaactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcaagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacga

SEQ ID NO: 19472 - DNA, 383 bp, Homo sapiens
  ENST00000543435
tctgctcctggagcctttgaataaaaatgcacgtagctgaggccggatgcggtggctcacgcctgtaatcccagcactttgggagaatcatgtgaacccgggacgcaggggttgcagtgagcggagatcgcatcattgcactctagcctgggccacagggcgagactccgtctcaaaaaaaaaaaaatgcacatagctatcaagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacg

SEQ ID NO: 19473 - DNA, 4414 bp, Homo sapiens
  ENST00000486749
actttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagagtgagtatccttcacaccttactacatgaattatatggttgtggtttgttttagggatgattgtactggacctactttctgttacactctttccctgcctctcagaatccaagtgaggagggttctgattactcctgagtaaaattttcagcccctaaagaatgaggtgaaaaggcgggtttaggaatggatgctatcaggcagggtgtgatggctcatgcctgtaatccagcattataagaggccgaggcgggtcacctgaggtcaggagttcaagacctgcctgaaacaacatggagaaaccctgtctctactaaaaatacaaaattagccgggcatgggggcgcatgcctgtaatcccagctacttgggaggctgaggcaggagaatcgtgtgaacccgggaagtggaggttgcagggagctgagatcatgccattgcactccagcctgggcaacaaaagtgaaactctgtctcaaaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttaactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcaagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacg

SEQ ID NO: 19474 - DNA, 1030 bp, Homo sapiens
  ENST00000469295
ggctgaggtgggaggattgcttatgcccaggagatcgatgatgcagtgagctattgtagtgccactgccctccagcatgggcaacagagtaagaccctgtctcaaaaaataaaaataaaaataaatccaagccttttgactccacagccactctttgtattgtacgtcagggacaggaggagcttgccgttaattgcttctgggaacctagatactaggttacactgtctttaaatttaattttctctgttccttgctcttacaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaagg

SEQ ID NO: 19475 - DNA, 870 bp, Homo sapiens
  ENST00000479059
tgagatcatgccattgcactccagcctgggcaacaaaagtgaaactctgtctcaaaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctctatttctggtggaaagggcaggaagaaggactctgcatatgataggccttggagggatggctttttgttccacgctcatgactgtttctttgttattaaaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctcactatttaggagcctacgtttttattatcttcaccggcttcctcattaccttcttggcttttaccttcttcaaagtccctgagacc

SEQ ID NO: 19476 - DNA, 943 bp, Homo sapiens
  ENST00000490763
ccagcctgggcaacaaaagtgaaactctgtctcaaaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgttctattactcaacaggaatcttcaaggatgcaggtgttcaagagcccatctatgccaccatcggcgcgggtgtggttaatactatcttcactgtagtttctgtaagttggatggtttggtaattttgaggggagaaaagaatccttgctacagatgttcaaagatggattgcatgaccctaccatcatttagttacctttttgttgcttaattttcctttgggaaaaagagataaatttaatgttggatgtagtcttcactcttcaagcaaatatgggatggatgggaaaggagggagtatagaagggactatatagtatgctttgaacttggaattggaggaaaggtgcttggaaaaactctcaagctctgttactccactgtttttacactaaaacaacaataatcaacagaagttatctgtgatccccagaatatgtgagaatttttccccgtgaggtgtgcaatcagttccgtagtggacaccatctaggtgtcctgcgattttttaattatgacactgtctacctggagatagcatcagatctcacaggttggtggcccagttcccaagactgccccccact

SEQ ID NO: 19477 - DNA, 1784 bp, Homo sapiens
  ENST00000495813
agactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagagtgagtatccttcacaccttactacatgaattatatggttgtggtttgttttagggatgattgtactggacctactttctgttacactctttccctgcctctcagaatccaagtgaggagggttctgattactcctgagtaaaattttcagcccctaaagaatgaggtgaaaaggcgggtttaggaatggatgctatcaggcagggtgtgatggctcatgcctgtaatccagcattataagaggccgaggcgggtcacctgaggtcaggagttcaagacctgcctgaaacaacatggagaaaccctgtctctactaaaaatacaaaattagccgggcatgggggcgcatgcctgtaatcccagctacttgggaggctgaggcaggagaatcgtgtgaacccgggaagtggaggttgcagggagctgagatcatgccattgcactccagcctgggcaacaaaagtgaaactctgtctcaaaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgagtgtgatactttagggtcaaacgtgtcttaaagtatttcacttaaaatgccgggcatggtggcggtgtgcctctgtagtcccagctactcaggaggctgaggtaagaggatcacttgagctcaggagtttcaggttgcagtgagctataattatgccactgcattccagcctggga

SEQ ID NO: 19478 - DNA, 577 bp, Homo sapiens
  ENST00000544291
gagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccagatctttgg

SEQ ID NO: 19479 - DNA, 589 bp, Homo sapiens
  ENST00000544936
agagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagtctgttcttccaccaacccttttattttgcagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggcgcaattcaatgctgattgtcaacctgttggctgtcactggtggctgctttatgggactgtgtaaagtagctaagtcggttgaaatgctgatcctgggtcgcttggttattggcctcttctgcggactctgcac

SEQ ID NO: 19480 - DNA, 763 bp, Homo sapiens
  ENST00000476634
agagatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggtattgactagaaactgggcaaggaagtgggctctaccagccacattgaggacaagtgtggagagttagggcagggaggtgatgatgcctttgaataagaacaccttgaattctaatcaagggaaacctagtccaactggccccgaatatgactgcccttgcttggagctctactaccctggagagctcccacccagctgtgcaagagatgaactgtgagtgattggcctttgcagtccagctagggatagttcagaattattccctagtaaactcaactatggggtttctagaaacatacttaatttacaaggtccgaagttgtttacttgtattataaa

SEQ ID NO: 19481 - DNA, 590 bp, Homo sapiens
  ENST00000541671
gatgctgtaatggtaagactttggatccttcctgaggacgtggagaaaacttgctgctgagaaggacattttgaaggttttgttggctgaaaaagctgtttctggaatcacccctagatctttcttgaagacttgaattagattacagcgatggggacacagaaggtcaccccagctctgatatttgccatcacagttgctacaatcggctctttccaatttggctacaacactggggtcatcaatgctcctgagaaggtgagtgccaggccacaataattagaatttagaatagggaagttattcctttaagtagggtttcaggaattcagaatttaaggccaggcatggtggcatctgcctggagtcccagctactcctgaggctgaggcttaaagatcacttgagtccaggagttaaacaccatcctgagcaacacagttagtgagggtccctccccaaactaggggattttaagacaaactttgtatctatcctgtccaagactgaagatggagacaatattggtggggaaaattagtggggtcatctaatcgaagcacaaagctcacttactcccggaacgctgg

SEQ ID NO: 19482 - DNA, 3426 bp, Homo sapiens
  ENST00000317370
gtgaagggcgtggcccgcgggggcaggagcgaggtggcgggggcttctcgcgtcttttcccccagccccgctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggaggctatggggccctacgtcttccttctatttgcggtcctcctgctgggcttcttcatcttcaccttcttaagagtacctgaaactcgaggccggacgtttgaccagatctcagctgccttccaccggacaccctctcttttagagcaggaggtgaaacccagcacagaacttgagtatttagggccagatgagaacgactgaggggccaggcaggggtgggagagccagctctctctacccggcccagagaccccttcctttcctctgcagcactttaaccctctcttccctattatttccgggtggaaaagaatccctgcagcctggtagaattgggaagctgggggaagggtggtctgagcaccccctcattcccctcgtgtgactctcttggattatttatgtgttgtggtttggccgtggccatcagggtgggccactctcccctccctcttccttcccccatcccctttcctccccaccttccccagactcagctccagaataccttcttcgctgctagagaagggggattggagggaagacaggtctagactttctcagtgggacaaaccagagcagagagcaggacaggagacaagaaatccagtttcccaccaccttggactcctcccacaatctgggactttcactgaattcttgccacgcagactctgggcaaaggggtttttttttttttttttttttttttttttgagacagtctcgctctgtcgcccaggctcgagtgcagtggcgtgatcttgcttcactgcaagctgtctcccaggttcacgccattctcctgcctcagcctccggagtagctgggactacaggcgcatgccaccacacctggctaatttattttgtatttttagtatatacgcggtttcaccatgttagccagaatggtctcgatctcctgacctcgtgatctgcctgcctcagcctcccaaagtgctgggattacaggcgtgagccaccgcgcctggcgaagggagttctctcttgacccctgcagggaaaaggactcacctccctcactgcaggctcagccttccagggcaagagggaacaggaaagtatgtgcccatgtgtggcaagatggaaggacggcaggctcccgcctctaggcttggggctctaccccgatggtttcccaaggctgccaagaaggagccctaactttcttcctctcccttcctggaagggtgctgcatccacaggcttttgaccaactaaggcaaagaggggatttgaaaggctgcctggaaacactgggctgggaggagcctttggatatttttatatacgtttgaaaaggggattgagagaagaaaccaaaggtcggttgtactaaatgtatatatatagatacttctataaagtcactgctgaagacaagcatcctattgtggaggtacttgaggatgggctgagacagggaccataactcttcacccctcttcctccctctgtcctgcctcagctcaaggcctcagaatcttctggatgccattgctcatgcccctactcacatttctactcgttgctttattaatagtaaatgctcaataaattgtagctgccagtgccgggcattgctcttggcatttgcagaatactcactctgtgagggaggtgtcagcccatgtcacagatgggcagtgaaacccatgataggggcactcttcaccagggacacagctggagacatggcagcaaggatgccaggccctgcccacggccccacatcccctcctccccaccttcaacagtgagttactagcgattctccaaaacagaagagatggagaccaagaccaca

SEQ ID NO: 19483 - DNA, 2995 bp, Homo sapiens
  ENST00000572485
cgctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtaactgctcacctctggaatggcccgagccactggcttcacctccctgggtgtcccggaggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggaggctatggggccctacgtcttccttctatttgcggtcctcctgctgggcttcttcatcttcaccttcttaagagtacctgaaactcgaggccggacgtttgaccagatctcagctgccttccaccggacaccctctcttttagagcaggaggtgaaacccagcacagaacttgagtatttagggccagatgagaacgactgaggggccaggcaggggtgggagagccagctctctctacccggcccagagaccccttcctttcctctgcagcactttaaccctctcttccctattatttccgggtggaaaagaatccctgcagcctggtagaattgggaagctgggggaagggtggtctgagcaccccctcattcccctcgtgtgactctcttggattatttatgtgttgtggtttggccgtggccatcagggtgggccactctcccctccctcttccttcccccatcccctttcctccccaccttccccagactcagctccagaataccttcttcgctgctagagaagggggattggagggaagacaggtctagactttctcagtgggacaaaccagagcagagagcaggacaggagacaagaaatccagtttcccaccaccttggactcctcccacaatctgggactttcactgaattcttgccacgcagactctgggcaaaggggtttttttttttttttttttttttttttttgagacagtctcgctctgtcgcccaggctcgagtgcagtggcgtgatcttgcttcactgcaagctgtctcccaggttcacgccattctcctgcctcagcctccggagtagctgggactacaggcgcatgccaccacacctggctaatttattttgtatttttagtatatacgcggtttcaccatgttagccagaatggtctcgatctcctgacctcgtgatctgcctgcctcagcctcccaaagtgctgggattacaggcgtgagccaccgcgcctggcgaagggagttctctcttgacccctgcagggaaaaggactcacctccctcactgcaggctcagccttccagggcaagagggaacaggaaagtatgtgcccatgtgtggcaagatggaaggacggcaggctcccgcctctaggcttggggctctaccccgatggtttcccaaggctgccaagaaggagccctaactttcttcctctcccttcctggaagggtgctgcatccacaggcttttgaccaactaaggcaaagaggggatttgaaaggctgcctggaaacactgggctgggaggagcctttggatatttttatatacgtttgaaaaggggattgagagaagaaaccaaaggtcggttgtactaaatgtatatatatagatacttctataaagtcactgctgaagacaa

SEQ ID NO: 19484 - DNA, 1768 bp, Homo sapiens
  ENST00000571308
gctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggtaggtccccccgccccagcctcccacaccgtaggccagaggtgggcatcacacagctagcccacctgcttccccgtcagggactcctccagccacagaccatgggtctttgggtcagtttggtggaccacctgctccacagaatcaaagcaaggaagggagctgacctagattggatagtaactgaggtgtctgaaacgcaccagtggcataacttaccttactccaagaataaaatgatac

SEQ ID NO: 19485 - DNA, 1813 bp, Homo sapiens
  ENST00000570783
gccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggaggctatggggccctacgtcttccttctatttgcggtcctcctgctgggcttcttcatcttcaccttcttaagagtacctgaaactcgaggccggacgtttgaccagatctcagctgccttccaccggacaccctctcttttagagcaggaggtgaaacccagcacagaacttgagtatttagggccagatgagaacgactgaggggccaggcaggggtgggagagccagctctctctacccggcccagagaccccttcctttcctctgcagcactttaaccctctcttccctattatttccgggtggaaaagaatccctgcagcctggtagaattgggaagctgggggaagggtggtctgagcaccccctcattcccctcgtgtgactctcttggattatttatgtgttgtggtttggccgtggccatcagggtgggccactctcccctccctcttccttcccccatccccttt

SEQ ID NO: 19486 - DNA, 1852 bp, Homo sapiens
  ENST00000424875
gattccaatcctaccaaaaggcagagtgggtctggagggcctttcggggcacaggcagcaagtggattctgcgagccagggttcacccccttgcctagtaggcggcgcggcgctccggaatcggggacaccctgccctcgatccgactcgggaaagcagatccaggcgggtcttgccctccgggagctgtccgtccgtcttcgctcacgggcagtgtttcgaggaccggaggctctccgtgggcccccacccccactcctggccgccctccaggacgctgaactttcccttggccccatggatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaatgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggtaggtccccccgccccagcctcccacaccgtaggccagaggtgggcatcacacagctagcccacctgcttccccgtcagggactcctccagccacagaccatgggtctttgggtcagtttggtggaccacctgctccacagaatcaaagcaaggaagggagctgacctagattggatagtaactgaggtgtctgaaacgcaccagtggcataacttaccttactccaagaataaaatgatacactttgcattaatact

SEQ ID NO: 19487 - DNA, 3448 bp, Homo sapiens
  ENST00000497341
aaagggaattccagccgaggtccggggccagtaggtcagggctgacttcttttaaaaaccctattttcttgttattaaaataaatcattgtagaaaataaaatacagatgaatgaaaaaaataacataacagtagttaattatacctgtagtcccatcacctgagaaaaccccaaatcacatttttggtgtatatcccccaatttattttccatgcctatacacactacatgatattttctaaatggaagcagactccatcatttcaccctggcaggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcaggtaaggcccctgcatggcccagtgactctccaatcttgccagagggcacccgtcagggtcccaagcaggtctctgacagcttgtctccccccccacccgcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttgtacgtcccagtatggagcaggcaccttgtggggcccagggcgaggggtcttcctccaggatgggagagctggctctctcctccccaccagacacacagacacgcacacacagctctccatgggctgccctgcgtgtgcctgagaagggtctgggatagagacctaaaattcagtcagcagatctctgtcaagggcctgccatgggccagccactctgatgagggctttcatcaacatgattgcatttaaacctcacagccaccccatgaggtaggtagcattacccctagtttaccattaatgcagtcaatcccaacaggtgacttgcccaagtcacatatctatttaagtaacagggccagcttccgaatccacatgtgtggcaccaagtctggtattctttcccccaggctgcattgtttatctctcttgcaaaatgctgttttcttccaggggctgggaaagggctactggggaggtgagacatggagatgggggtataggaggccaggagcagggccctaggctgaggtgctctgcttacccctcagaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcatctttcagcctgtgtgctgactcctcaggagggggaagtcaaataggtcacttgagaacaacagaatccctcctgtcccttcccagcctctggagtgacctcccacagacctcctgtcccttcccagcccctccaccctcagatggagggtaaaagccaccagtctctttactccccttcccctggctcacagcatgcctgggtccttggctcagggacagtcccatgtgccctgggcttggttgcaggagaatgctggaaggtaaggagccaaggaatccctgggagtcagtcgttctcagaggtccctgcatgccagtgggcctcaggctggctggagggaggctgggtccctttgagggagaatggctagaccatagcactgatgtgggcttggttctcaggccatctaaggtgtccagcggtagggacccctcaaccctgatagcagccaaccctgagtccaggtttaggctgtgaacaccaaggacctcttttacacctattccccctttgtcttaagaactgcatattttgacacattaagtcttaaaatcaggctcattaagggattgttgattttctctttaaaaaaaatcaaactcaagctggacatagtggcctgtgcctgtaatctcagccctttggaggctgaggcaggaggattgtttgagcccaggagttcaagaccagcctgggcaacctagggaaacccctgtctctacaaataatttaaaaattagctgggtgtggtggtgcatacctgtagtcccagctattcaggaggctgaggcaggaggattgcctgagcccaggaggtcaaggcagcagtcagccatgatcatgccactgcacttcagcctgggcaacagagcaagaccttgtctc

SEQ ID NO: 19488 - DNA, 3447 bp, Homo sapiens
  ENST00000482990
ccaccagacacacagacacgcacacacagctctccatgggctgccctgcgtgtgcctgagaagggtctgggatagagacctaaaattcagtcagcagatctctgtcaagggcctgccatgggccagccactctgatgagggctttcatcaacatgattgcatttaaacctcacagccaccccatgaggtaggtagcattacccctagtttaccattaatgcagtcaatcccaacaggtgacttgcccaagtcacatatctatttaagtaacagggccagcttccgaatccacatgtgtggcaccaagtctggtattctttcccccaggctgcattgtttatctctcttgcaaaatgctgttttcttccaggggctgggaaagggctactggggaggtgagacatggagatgggggtataggaggccaggagcagggccctaggctgaggtgctctgcttacccctcagaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcggtgagtcacactggccccagctagttactacctggaacataccccaccccaaacatgggaccatagcttgagttactggaattgtttcagtcttttttgatctgtctctgtttctctgtgtctctctctctcacatagacacatacacacacacacacatgcacgtgcgctcgtgcatgttggagacaaggagtctccatccactggatgcagtgttctgggggcagtttcaccctctttgaagtagcacagggaaccaacaaccctttaaaagatcattagtacctacaggtctagtgatggggcacagttaggtaaattacagcacctccaccctgaggtatcacataactgttaaaaatgatgcttgtgaagactgtacagcaactatgaaaaatgtttatggtataatgctgagaaaaaagctgaatataaaattgcatctacattatgattcaactattaaaaatatatatggtgagtcatgagctgacaaaggatttttgagtttcttccagatgcaagaagcaatcagagtcatgcaatttgtatgccaaaaatattataatttgtgggatatttgatggaaactctagagggacaatgagacagatatttaacaactggattgtcctgggaaatcgggtggtatggctgctgaaatgttgagctgtatgttgacacttaatgacaggagagaataggagactggaaagagtttagtgtgttagcatggttgattggggtgagtctctccaacatttgatttgacacttttatgctgttcatacaatacagaaagaaaagcaggcttccattcacgcctggctttaatgctgtgcagcccctttccctgtccttatctcagtccctgcctgttctttctcccccgggatggatgccgcctcttatcactctcccacagactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcatctttcagcctgtgtgctgactcctcaggagggggaagtcaaataggtcacttgagaacaacagaatccctcctgtcccttcccagcctctggagtgacctcccacagacctcctgtcccttcccagcccctccaccctcagatggagggtaaaagccaccagtctctttactccccttcccctggctcacagcatgcctgggtccttggctcagggacagtcccatgtgccctgggcttggttgcaggagaatgctggaaggtaaggagccaaggaatccctgggagtcagtcgttctcagaggtccctgcatgccagtgggcctcaggctggctggagggaggctgggtccctttgagggagaatggctagaccatagcactgatgtgggcttggttctcaggccatctaaggtgtccagcggtagggacccctcaaccctgatagcagccaaccctgagtccaggtttaggctgtgaacaccaaggacctcttttacacctattccccctttgtcttaagaactgcatattttgacacattaagtcttaaaatcaggctcattaagggattgttgattttctctttaaaaaaaatcaaactcaagctggacatagtggcctgtgcctgtaatctcagccctttggaggctgaggcaggaggattgtttgagcccaggagttcaagaccagcctgggcaacctagggaaacccctgtctctac

SEQ ID NO: 19489 - DNA, 2260 bp, Homo sapiens
  ENST00000233535
gggacggggctgtggagatgaggagttctccagaactcgggtggcggggcgctcccgggctctggcgcggggaaatggggctttggcagtgggggcggggcttaagggtggggagaggccggggagcctggaggcggagcttggggagctcgccccacgcggggcggggctccggcggcagcgggatctgcagttcggactccgcgcgccacagtcgctgcagttcgctccactctggtggccccgccgccctgcggggatcccgggggtcggcgggctgctcggacttggcgcggggccggcccggcctctctcttcctcggtggggcctagacggtcggggcaccgggaacatggagccctctccagccgctgggggcttggagaccactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgca

SEQ ID NO: 19490 - DNA, 904 bp, Homo sapiens
  ENST00000445870
cactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagct

SEQ ID NO: 19491 - DNA, 899 bp, Homo sapiens
  ENST00000432351
gactgtcacagcttcgagtgcacaatcctcttcccaccccctcccattctacagtggcggcaggtgcgaggggagagaacattgagcatttgaagcttcgacttgaggctcggccaccgactttgcttctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttctt

SEQ ID NO: 19492 - DNA, 997 bp, Homo sapiens
  ENST00000426924
ctgctctcaaaccaccccacttctgtccctcagaggtgggacagtggggagaggaggaagaggactcagaggctggagaaggaagagaaaaggcgttgctgtgggaaagacctggcaaggaaaaggcagcggaaccccagagagcagggtagacgcctgcggcccaggagaaccgagcaaggcaaggagctcaaagggagagctctgagtgtgcagggcacctctggccctgtgccgactcctcacctgggtctggccctttacctgggagtcgttctcttaagccaggagggcaccacccatcttgatggcccaactcactccaggaaacacaatgggtttgctgaccgtggcggatgagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctc

SEQ ID NO: 19493 - DNA, 834 bp, Homo sapiens
  ENST00000424577
gcttagcaggcctgcggcccaaggcagcgtaggagcgttgctgccaggccttggggcagggattcccaccgagcccctcttccccagcaggagggcaccacccatcttgatggcccaactcactccaggaaacacaatgggtttgctgaccgtggcggatgagagtggcggcaggtgcgaggggagagaacattgagcatttgaagcttcgacttgaggctcggccaccgactttgctgtaatgggtccgctcctgtttctgcctccgcgtgagggttgcggccacagggtgacggcgtggtgggcgacacccccgcgcaggcatgcacagagtggtggtcgttgggcgaagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgt

SEQ ID NO: 19494 - DNA, 501 bp, Homo sapiens
  ENST00000486309
ggcctggggaaggagatggtctgatgaggccagcactggggactaaggacgtggagtgagcaggccagcctgtgggccaggcccaggttgaaccatgttgcttgcctcagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtac

SEQ ID NO: 19495 - DNA, 540 bp, Homo sapiens
  ENST00000450118
acagcgggccgggggtggcaggagaaccgccaacgcgccccgccggcccccgcgcctgccgccaccgtccacctgcccctctgagcggccgtccgacctccctgcccacccccgtgggccatcttgtctgtcggctgaccgtccgtttgtctccggaatttggcaggagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcct

SEQ ID NO: 19496 - DNA, 590 bp, Homo sapiens
  ENST00000426569
gagggcttagcaggcctgcggcccaaggcagcgtaggagcgttgctgccaggccttggggcagggattcccaccgagcccctcttccccagcaggagggcaccacccatcttgatggcccaactcactccaggaaacacaatgggtttgctgaccgtggcggatgagagtggcggcaggtgcgaggggagagaacattgagcatttgaagcttcgacttgaggctcggccaccgactttgcttctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggc

SEQ ID NO: 19497 - DNA, 1785 bp, Homo sapiens
  ENST00000259392
ctcgcccggaccacgtgatccgtgcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaata

SEQ ID NO: 19498 - DNA, 771 bp, Homo sapiens
  ENST00000490809
agctatcgcggcggcggcggcggcggcggttgaactgactcggagcgaggagacccgagcgagcagacgcggccctggcgcccgccctgcgcactcaccatggcgggttcacctgggctggagagaacgacagcttgcaagactcgttcgtctttgaagaagtcatatcattttcttcatcccatgaagaatgtcatagaatttaagatacaggaagctcagcctgggcaacatagctagaccccgtctctacaaaaattagccacaagtggtggcaggcgcctgtaatcccagctactcggaggctgaggcaggatgaggaggattgcttgagcccagaagttccaggctgcagtgagccatgaccttcggcctgggcaacagaacaagacgtcctcaaacaaacaaaacaaaaaaaaaaagatataggaagtgtatgtaggccatttagtgaaatgatcagccgtcctttaaaaagggaaatagatggaaagcacttgcaaaagttccccagccagtcagcctagcaactgggaccttcatctccttcccaacccttgtttacaaataaggaagcttttctcaaagtgtaagtaaccccaaatgaagaaatatagaagaaaacaagttccagggattgctccctccttcaccacagccccaccctgaaaaaagcacaaatcagttaaactttcagaggccaagattcatcccaagtaggaaaacaagattggggccctgccccttgcctatctgaccacaaagcccttt

SEQ ID NO: 19499 - DNA, 1750 bp, Homo sapiens
  ENST00000374220
ccgagcgagcagacgcggccctggcgcccgccctgcgcactcaccatggcgatgcatttcatcttctcagatacagcggtgcttctgtttgatttctggagtgtccacagtcctgctgggcaagaaactaaagcccagagacaggaagagagactcgtgcagggtcacacagcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaata

SEQ ID NO: 19500 - DNA, 2574 bp, Homo sapiens
  ENST00000217420
gctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggct

SEQ ID NO: 19501 - DNA, 6162 bp, Homo sapiens
  ENST00000235345
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagctgtgaatgggcactgcctaaattgcctcttggggtaatctggagggtggaggtgttaactcaaacataaccctatgacttgactcagagatatccattgactttgaggattagtgtgtttgctcaggccagttgtacagccagtgtgcaagagatttggtacctttgcactaatgcacacaccagtgtctatttcattgggtttggaatccactggactctgttgacctaaacagttagggttttgattttttttgatatgcaaatttatattgagatcattttcatattcctgtcttttggtttgtctttactaaagcttggctggtggtgctgtgtccctagaattatccctgcaaccaactcccaagttacaagcttcattaagagccttagactcacttttttctagcatcttctgacctgagaaaattccactgggagtaaaggatagtatcttgtgtcatatgggtcttactctccctattttaccaatgagaaaacaaaactcagagaaagatgacttgctaatacatcaaacccatgtcctttttattgaactatgctgccatttaattaaccgcccttcccctctgagggagtaaggaaacagatcctgagttcacttgagcactttcaaaaaagcaagcagttgattgaatttggtgtcagagaggagcatactttgcaaatcaggaagagtgacagcttaccctgtcctggaacccttatcccacttccaggctgactttagttgataatgcacttctggctgtaaatgttgccaacacttcctggttttgcttaggtacagtgaaagggcatagtgagagctatttttagtgattctgttctttctgtcagcaacatgaaggagggacgtttgaataatttttgttgtagaatatttcttcatgaaaggcttttgggtgtctttaacaggtgttgggctagagccccaccaggagttgaactgcctcttgggggtcaggttccctaggagatctgtcacctcttcaggagtatttgagaacattgtgtagttacagcttcactaaatgcacgtgacaggcttctgtgccttgggagccctggcttatgctgaaacttctggctgaccagagcagtacagcaactttgccctgtctgtgttctgcttcctggatgcatccttcagccactaaccagcattgcaagatggagcagggtgaacaagctggagactgaatagtcttttggagtttgcgttttgattattgcaggcgtgttacaatatactggtgatttacctggtactgtggcacctcccagaaagtctggtttttgccccatgtttgatatttactaggcagaaattctttgtcctgttaactgcctcctgggagaaaaagaggcaatacagagttaaatccttaatttgcccactgagacagatgagctgtggtattccaaaagacaaattctatgactagtgtctcctgttcaatgtaagtgagaccctctttggccaatctgcttctagtcaaggctaaatggattggaataaccctagttggccaggctacacattgccagcatgtcccgttgagttttaattgcctcatgtggctgtggactttatgagtcaatcatttgtaggctccagtttgcacctagtttttttttttaaaaagtgcatttacacgcttttggtagtcctgttttatcaagaatccatggagggttttggtcagtacagctggtgcaggatcctcacggagaaacagtggagtttcacattgagttggtttgaaatggcaccccaggactttgggcctgccttacttgatagcctcgttcagtgagcaaagacttagtgagcagctcttgtatgccaagtattttgctaagctctggaaaaaagataaacaagacatggttcttgctttcaaggagtgtgtaattctttagccagatatggaaacctggaccctgagtgggagaaaggagacagatgaaaggagtccgtgattttgtaaccaagagctgcctgcatggttatgagtatcactgattttagggacgccccacagagctaaagcatttttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttcactgtcttttcttttttaaaaatatctgctggacacaattacggccattacatgatgcaggtgattctacctattttttaaaaagaacaaaatttcttttatattgtgacagtacattttaataaaggaaaattattttcttccccctactccccctccttttttttaaaaaaaaaaaaaaaaaagaaagaaggtcttgctctgtcgccagccaggctggagtgtaatggcgtaatcatagcagctcaccacagtctcaaactcctaggctcaagtgatcctcctgccttagcctgctaagtagctacgactataggcatgtgccattacgcctggctcgtttcttcctttttttttttttttctggtaaagacagggtctcactctgttgccagactggtctcaaactcctggcctcaagtaacccttctgtctcagcctcccaaagtgctgggattacaggtgtgtgccacatgtccggccaggaaaattattttctatcttaaagaaacatagttacattttagaatgtcaattcagttaaatctttctcagtttttacctttagatggctcctggaaaggccagcgttccttttcccctctctgaattgaaagcacttgaccccatgctgcccctgcttccaggcctgtctcagttgtcatatattgtgagtccctggcaccattactgttttctaagccagtcttctaggtcttactttcaggatgctgcttcatggcatgaggatatagtttacagtgttgtagtttttttttttttaaagctttgttctttaaaaatactttttaaaaagaaatctactggttagatttattgtctcacaaaaatgtttttagagattatttttttcacaaatgttttctttctcatgctgatgatcaactgatttttgtctacaggtgttagcttctcacagtattttttcattttagagtctatttaccaaatgaccatttttagtgttaaaaggtactgaggaattgaggtatgtaaatcaggtgacataaacatgaaaattatgtgcctaaatatttttgtaatggtgtaaaataaatactttttcctgaaaacaagtattaaaattcctttgtaactgcatacagagactaatccaga

SEQ ID NO: 19502 - DNA, 4852 bp, Homo sapiens
  ENST00000360388
gggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgccgcgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacagggagatgttaatctctgtggccctaggccaggtgttatccctccttatttgtggaattggcttgactagcaagtatctgtcagaagatttccacgccaacacaccagtcttccagagtttcctcaattacattcttctcttcttggtctataccaccacactagccgtcagacaaggagaagaaaacctcctggcaattttacgacgaagatggtggaagtacatgattttgggactcatagacctggaagcaaattatctggtggtcaaggcttaccaatacacaactctgaccagtatccagctcctggactgttttgtgatcccagtcgtgattttgctctcctggttcttcctgctgatccggtacaaggctgtgcatttcatcggcatcgttgtctgcatcctgggaatgggctgcatggtgggagcagatgtgcttgtgggaagacatcagggagcaggggaaaataagctggtaggggaccttctggtcttaggaggagccacactctatggtatttctaacgtctgggaagaatacatcatccgaactctgagccgagtggaattcctgggaatgattggtctctttggagcatttttcagtggaattcaattagctataatggagcataaggaactgttgaaggtgccctgggactggcaaataggactgctctacgttggctttagtgcctgcatgtttggtctctacagctttatgccagtcgtcataaagaaaaccagtgccacttcagtcaacctctccttgctcacagcagacttgtacagcctgttctgtggattgtttctcttccactacaagttttcaggactttatctcctgtctttcttcaccatcctcattgggctggtgctctactcctccacctccacctacatagcccaggacccccgagtgtataagcagttccgcaatccttcaggacctgttgtggacttaccgaccacagctcaggtggaaccctcagtcacctacaccagcctgggccaggagaccgaagaggagcctcatgttcgtgtggcctagggtgaggcccgccctgccaactgaggccaactcattggccatgtttttgcccatcatctctgtattgtacatagagaaaggtatttactaggtgcagtttacacaggtggactgcaaggtagcaaatcctccaaaagcttgtgaaaggaacaagctcaacatcactggagacacaggctctaatccacctgacttggaaggatgcctagctaacgtgtatcctgatcacaactcccctgcattcattactgtgaaaatttttgaatcaaaagcaagtattattgttattatgatttgtattattattattgctgttactgttattacaccaactttcaggaggatgttttgtactcctgatggaaactattgccagacccacatgtagtcaacataaaccccacttttctatggcaattcactttttaagagtcatactttatttttttgcacagactatatgagtgatgcatgccacaggagctccacccctgagaagtttccttttcctagggacctggtggttaatggtttcctctgttacctgttggattgcctgctcaataagtattttgtgctgtgacctttgtggggaggggcaactgaccatatacttctctattctaggaatagatataaaagaaacattttagcctttttatatttcgatctctgattactccaggccattgcctttctgttgtgccacgtgattctgctaatcaagtccctgtaataacaggataaggactgttccattactgtggcttttgggagcccccagaaataatatcatttgtgtttaggacaatatataattataaaatctttctgctcctccctgtagcctctcttcaaaaactatcttttattttttttccagatttccttagtgataatatggaaattaatcaaggcactggaaaaagccatggtcctctgcccttttaattctgtgacacctttttaaaaatacaccagcatggaaattacctttattgtggaaaatcattggttgtgccacctcctaacaaagtcaaggtgctgatgtggagcagtctttgaaaatggcttaattgatttggccactttgcagtggtaacaatgtcatcattgaaaaagtctggcattttggtcatatttggcatccattcaataacagatatattgacacgacattcttttttttttttttttttttttttgagacggagtctcactctgtcgcccaggctggagtgcggtggcacgatctcagctcactgcaacctccgcctccgggattcacaccattctcctgcctcagcctcccgagtagctgggactacaggcacctgccacgacgcccagctaattttttgtatttttagtagagatggggtttcaccgtgttagccaggatggtctcgatctcctgacctcgtgatccgcccaccttggcctcccgaagtgctgggattacaggcgtgagccactgcgcccggccgacacgacattcttatggacccagagaatactgcaggatcctgataagaccttgagtgatatgtcactagtctaatctgttgcccttaaaatagcccttttttcaaacacaggaaattaagaaacaccacagacctctattatttagaatagattctatgtgtcagtatgtgatgtactcttttagtttgactgacttcaataccattcaaaaagatcctcaatggagttacagggtttataggggaaaaatacatgtttatgagacattgggcaattcaaatcaacatgtgttacataagcaagcaaagcaaaacaccagtggggtctctggaaagtaaaaggacagactacagtagaaggactgatcccagagtgcctgtacaaggcctaaatctggcaggcaaaagcatcccacactgtctgtcagcacccacatggcctttttgcctgccttctataacgggtaagtggacctacccttggagatagagaagaaaaattatcttctctgatattcggatgtaatggtcatctcagttcagccccctaggaaacatgttttattttccatggggaaaatatcagcgttaaagctctatcaaatcaaaacaactttgccaacatcttctctctgctaccttttaaaccaattaaatacctttctctgaatattttgtccattcagatccgaagacctttaaagactgtggttttatttttgtgtttacattcctttggtttgaataatttgcttgatttattgcatttttagtatttattttaagccagatgttttcatctttgattcatttttatgacattaatttgtagacacttagtaaagtcttatgagaagcaagtggatgaaattatctccaagtccactcagtagactggagttttttaaaaatataaatttccaaaaagtttgcaatcaacagatggctaaaggttgccatctgaattattttataggatattttaattgactccattgtatggaaaccaagtgtgaatgttaagatgaatttgccgtataccctttatcattcggtgtccttgtactcagactttcatgtccctgggtgacctcaatgtgttggtttgtctccatttagaaaggttgataatatattgaattgttcaagatcaggagttccagactgaccctccaggaaaaaaaaaatcgcaaagaacaaattctttttctgtgtaaaaaacactgatcctttgggaatggggcgggaaatgggagtaggacaacattaactttagctgttttagtttctgagatttcataacctcagtagacaccagcaaaattttcagtttctaactccaccaccaatctctcctcaatgaataagactttagcaatttatatagaatttgatcaggtaagagcgaaccacaattctcctgaaccctgctagagattaagtggtggttctcacttcctcaatgaaaacttgcactggggacagcgcttgccttggtcagaccttcccacatctacatactctcaaatacatgaccaggtgatcaagcaatggaaaaatttgcaccaccgtgtcccatgaaattgtttcaatgtttagtttagatattgctaacttgtgctattaaccttttgacaagcgtgtagtattgtttgttttgggtttctttttgatttataactatttagtagtccccagctagctaccagtacagattttaccccatgggtaggattctattgttaagccacataacaaagcacactaattctgacaacactgcaaatggaaaatacgaaccaaaaaaaagttacaccgataagttcaacaaactgtccatttttgatatttgcatgctcccctatggactggctgtggcaatgtaatgcctgtataatgttttcaaataaaaataaatgctttatgaaagcaccgaa

SEQ ID NO: 19503 - DNA, 4481 bp, Homo sapiens
  ENST00000621341
cagggagatgttaatctctgtggccctaggccaggtgttatccctccttatttgtggaattggcttgactagcaagtatctgtcagaagatttccacgccaacacaccagtcttccagagtttcctcaattacattcttctcttcttggtctataccaccacactagccgtcagacaaggagaagaaaacctcctggcaattttacgacgaagatggtggaagtacatgattttgggactcatagacctggaagcaaattatctggtggtcaaggcttaccaatacacaactctgaccagtatccagctcctggactgttttgtgatcccagtcgtgattttgctctcctggttcttcctgctgatccggtacaaggctgtgcatttcatcggcatcgttgtctgcatcctgggaatgggctgcatggtgggagcagatgtgcttgtgggaagacatcagggagcaggggaaaataagctggtaggggaccttctggtcttaggaggagccacactctatggtatttctaacgtctgggaagaatacatcatccgaactctgagccgagtggaattcctgggaatgattggtctctttggagcatttttcagtggaattcaattagctataatggagcataaggaactgttgaaggtgccctgggactggcaaataggactgctctacgttggctttagtgcctgcatgtttggtctctacagctttatgccagtcgtcataaagaaaaccagtgccacttcagtcaacctctccttgctcacagcagacttgtacagcctgttctgtggattgtttctcttccactacaagttttcaggactttatctcctgtctttcttcaccatcctcattgggctggtgctctactcctccacctccacctacatagcccaggacccccgagtgtataagcagttccgcaatccttcaggacctgttgtggacttaccgaccacagctcaggtggaaccctcagtcacctacaccagcctgggccaggagaccgaagaggagcctcatgttcgtgtggcctagggtgaggcccgccctgccaactgaggccaactcattggccatgtttttgcccatcatctctgtattgtacatagagaaaggtatttactaggtgcagtttacacaggtggactgcaaggtagcaaatcctccaaaagcttgtgaaaggaacaagctcaacatcactggagacacaggctctaatccacctgacttggaaggatgcctagctaacgtgtatcctgatcacaactcccctgcattcattactgtgaaaatttttgaatcaaaagcaagtattattgttattatgatttgtattattattattgctgttactgttattacaccaactttcaggaggatgttttgtactcctgatggaaactattgccagacccacatgtagtcaacataaaccccacttttctatggcaattcactttttaagagtcatactttatttttttgcacagactatatgagtgatgcatgccacaggagctccacccctgagaagtttccttttcctagggacctggtggttaatggtttcctctgttacctgttggattgcctgctcaataagtattttgtgctgtgacctttgtggggaggggcaactgaccatatacttctctattctaggaatagatataaaagaaacattttagcctttttatatttcgatctctgattactccaggccattgcctttctgttgtgccacgtgattctgctaatcaagtccctgtaataacaggataaggactgttccattactgtggcttttgggagcccccagaaataatatcatttgtgtttaggacaatatataattataaaatctttctgctcctccctgtagcctctcttcaaaaactatcttttattttttttccagatttccttagtgataatatggaaattaatcaaggcactggaaaaagccatggtcctctgcccttttaattctgtgacacctttttaaaaatacaccagcatggaaattacctttattgtggaaaatcattggttgtgccacctcctaacaaagtcaaggtgctgatgtggagcagtctttgaaaatggcttaattgatttggccactttgcagtggtaacaatgtcatcattgaaaaagtctggcattttggtcatatttggcatccattcaataacagatatattgacacgacattcttttttttttttttttttttttttgagacggagtctcactctgtcgcccaggctggagtgcggtggcacgatctcagctcactgcaacctccgcctccgggattcacaccattctcctgcctcagcctcccgagtagctgggactacaggcacctgccacgacgcccagctaattttttgtatttttagtagagatggggtttcaccgtgttagccaggatggtctcgatctcctgacctcgtgatccgcccaccttggcctcccgaagtgctgggattacaggcgtgagccactgcgcccggccgacacgacattcttatggacccagagaatactgcaggatcctgataagaccttgagtgatatgtcactagtctaatctgttgcccttaaaatagcccttttttcaaacacaggaaattaagaaacaccacagacctctattatttagaatagattctatgtgtcagtatgtgatgtactcttttagtttgactgacttcaataccattcaaaaagatcctcaatggagttacagggtttataggggaaaaatacatgtttatgagacattgggcaattcaaatcaacatgtgttacataagcaagcaaagcaaaacaccagtggggtctctggaaagtaaaaggacagactacagtagaaggactgatcccagagtgcctgtacaaggcctaaatctggcaggcaaaagcatcccacactgtctgtcagcacccacatggcctttttgcctgccttctataacgggtaagtggacctacccttggagatagagaagaaaaattatcttctctgatattcggatgtaatggtcatctcagttcagccccctaggaaacatgttttattttccatggggaaaatatcagcgttaaagctctatcaaatcaaaacaactttgccaacatcttctctctgctaccttttaaaccaattaaatacctttctctgaatattttgtccattcagatccgaagacctttaaagactgtggttttatttttgtgtttacattcctttggtttgaataatttgcttgatttattgcatttttagtatttattttaagccagatgttttcatctttgattcatttttatgacattaatttgtagacacttagtaaagtcttatgagaagcaagtggatgaaattatctccaagtccactcagtagactggagttttttaaaaatataaatttccaaaaagtttgcaatcaacagatggctaaaggttgccatctgaattattttataggatattttaattgactccattgtatggaaaccaagtgtgaatgttaagatgaatttgccgtataccctttatcattcggtgtccttgtactcagactttcatgtccctgggtgacctcaatgtgttggtttgtctccatttagaaaggttgataatatattgaattgttcaagatcaggagttccagactgaccctccaggaaaaaaaaaatcgcaaagaacaaattctttttctgtgtaaaaaacactgatcctttgggaatggggcgggaaatgggagtaggacaacattaactttagctgttttagtttctgagatttcataacctcagtagacaccagcaaaattttcagtttctaactccaccaccaatctctcctcaatgaataagactttagcaatttatatagaatttgatcaggtaagagcgaaccacaattctcctgaaccctgctagagattaagtggtggttctcacttcctcaatgaaaacttgcactggggacagcgcttgccttggtcagaccttcccacatctacatactctcaaatacatgaccaggtgatcaagcaatggaaaaatttgcaccaccgtgtcccatgaaattgtttcaatgtttagtttagatattgctaacttgtgctattaaccttttgacaagcgtgtagtattgtttgttttgggtttctttttgatttataactatttagtagtccccagctagctaccagtacagattttaccccatgggtaggattctattgttaagccacataacaaagcacactaattctgacaacactgcaaatggaaaatacgaaccaaaaaaaagttacaccgataagttcaacaaactgtccatttttgatatttgcatgctcccctatggactggctgtggcaatgtaatgcctgtataatgttttcaaataaaaataaatgctttatgaaagcaccgaa

SEQ ID NO: 19504 - DNA, 1908 bp, Homo sapiens
  ENST00000556826
gggagagctgccaggctgacggagaggccggcccgagtgggggccgctccgccgccgccgccgccgccgccgctgtgatgcggagccggtgctgcgccgggcggtggagtcagagcccgggcgcgggagcaggagctgcaagatcagcaccagcggctccggcacctgcaccagctcccgggccccgcgctgcgctctccgccccgccgcactcggggccgtcgccccgcgctctctatggatgtcaaggcggcccccaacggggtggccactatcgaggaccggatcctgcggatcaccggctactatggctattatccaggttactccagccagaaaagtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatcaaggaattggtgtaaataatcataatggatttttttattaaaacacatttgtcctt

SEQ ID NO: 19505 - DNA, 1608 bp, Homo sapiens
  ENST00000554729
atggatgaactactcttggatctcttccacaaactgaccagtgggaggcagctggcagcaggcaatgggctttgcggtatatcacataaggaacaggaggtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatc

SEQ ID NO: 19506 - DNA, 2700 bp, Homo sapiens
  ENST00000557254
atggatgaactactcttggatctcttccacaaactgaccagtgggaggcagctggcagcaggcaatgggctttgcggtatatcacataaggaacaggaggtatggaagccaggacataatattttagtgaaaatgagaaaggaagataaatcactggtgtggcttatacattcaacacttgctcgctacacacaagttaccaactttttaggtaactatggacaatatttgatctcaatcccatcccaacttgctacccagcctatttctagactttctccttttgatgtataattgccaagggattggaaatggaatattgggaaaatgaaacccaatattaccctgagaaaagaggagaaggcataccttataaaaataaatttcaaaagataaattttaaaagactcttggagtatctgagcatcagccactcttgaagaacaggaataattgtgagttcactgaatttcagacagtccgtttttatcgaacttgaattgtccaattagaaacatagctgtacaaggtataataaacattctgaatatgtaaaataagaaccctgggtatttttgatgctcttataataacaatagtaacatagcattaatttaagtgtagcagtcagtatataatgcttctgttaactttctgagtaactgtaaatttttaattttctaaatccaagattacatagtacattttattttatttgtatgggtgcatagtaggtatatatatttacaggtacaggagatatttttatacagacataccatgtgtaacatgtcatctatcacctcaagcatttatcatttctttgtgttacaaacatttcaattatgatcttagttattttacaatctacaatcaattattgttgactgtagtcaccctcttgtgctttcaaatattagatcttactcattctaactatatgtttgtactcattaactgtccccactccctccaccctcaacccactatccatcctaggttctggcaaccatcattccaaagaaatagaagaaatagaaatgcttggagaagtgattaatttcaggagtggggcagggaaactataagacaagcccagggcatcttgcagtgccagaaagtaaggaagagctcaaacgcaaaagaatggggacaaatcaaaggtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggattgctgggaagccctgaagatttaaggagccagatctcattcatataatccggcatgccactatgatgaacatattgagacaacacttctttagaaggagatataccagcaataaaatccgttgtattaaagcaaatgagcacatttaactcatggacctcactgatgcaagaggttacgtccaaaaagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggc

SEQ ID NO: 19507 - DNA, 467 bp, Homo sapiens
  ENST00000556306
tttatttactggctttaaagaagctgacggccacggatgtctccgctctgttctgttgtaacaaagcctttgtcttcttgctgtcatggattgtgctgaaagacaggttcatgggagtgaggattgctgggaagccctgaagatttaaggagccagatctcattcatataatccggcatgccactatgatgaacatattgagacaacacttctttagaaggagatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttca

SEQ ID NO: 19508 - DNA, 535 bp, Homo sapiens
  ENST00000557430
agaacgatgctgtgtggctccctggattcagcccccttcctagggatatgtacagacggatctgccacctcgctgggaatcccggggccagaacagaaccatcaagactagccttttcactgtatagaaatgaatctccacttgctgttggcgttatcacagtgaccggagtgatacagaagagaagtgatgttggtgcatctaagagattctctctaccctcagttgggaatcaaccagctctcttacacgagaaaacttgccaccaggtgctcatcagtggtaacagccagctacactgtcttaaagcatgtgaatgctgagatcctagccagagaaaagaaagattctactgcaatacaaatttcaaaaggagacattccagctccccttcaagactacattttggattaacaacttccaaatagttatcttccccctaggttctctctgtagtacctccagatcatcagtcactagatgtaaaccaggagccaactgccccagttcacacagtggcatcagtagacaactg

SEQ ID NO: 19509 - DNA, 530 bp, Homo sapiens
  ENST00000556568
actcatagctaaaaaatctgccctttaaaatgtctcctcacgaagtaggaagcgccacttttgaccgtgtctgctgacatggtttttgatctgggaaagggggtgaggagccgactggaagcatcactttctgggatgtcagagtctccttggaagagtcctaattaaggactcagaatgattgacaggtggtggaagctcaagaaagcacacttgatatgcagcagaagacagtctgtgagttgcaaaaaacctggcaattggagaccttgaaaaacttttaaccatcaagactagccttttcactgtatagaaatgaatctccacttgctgttggcgttatcacagtgaccggagtgatacagaagagaagtgatgttggtgcatctaagagattctctctaccctcagttgggaatcaaccagctctcttacacgagaaaacttgccaccaggtgctcatcagtggtaacagccagctacactgtcttaaaggtgcctaccattgggcttttacagggaagctagtg

SEQ ID NO: 19510 - DNA, 358 bp, Homo sapiens
  ENST00000554648
tgggatgtcagagtctccttggaagagtcctaattaaggactcagaatgattgacaggtggtggaagctcaagaaagcacacttgatatgcagcagaagacagtctgtgagttgcaaaaaacctggcaattggagaccttgaaaaacttttgtgtaattggtattgatgttatccatatggtggacaaatgtgatgtctgcagaatgtcaagacaatcaaagtctctgcagactctactgtgagagagaaccctcagataagacataatgaatgcatactgctttcctttccatgaaaaatgtgaacctcttttgatcttccttactgataaaggttgagaagtatgtacttgctaga

SEQ ID NO: 19511 - DNA, 1779 bp, Homo sapiens
  ENST00000339762
atggatgaactactcttggatctcttccacaaactgaccagtgggaggcagctggcagcaggcaatgggctttgcggtatatcacataaggaacaggaggtatggaagccaggacataatattttagtgaaaatgagaaaggaagataaatcactggtgtggcttatacattcaacacttgctcgctacacacaagttaccaactttttaggtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatcaaggaattggtgtaaataatcataatggatttttttattaaaacacatttgtcctt

SEQ ID NO: 19512 - DNA, 8066 bp, Homo sapiens
  ENST00000398637
gcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgctggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcatagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcaggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaatatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatctgcactgaaatagaagtctctaggatctgcatataaacaataaatgtttcctagaaattagtggttttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 19513 - DNA, 3196 bp, Homo sapiens
  ENST00000549049
accgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtg

SEQ ID NO: 19514 - DNA, 3436 bp, Homo sapiens
  ENST00000439706
agaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagagtcaaggaaacttttgagctatttacagcttgtagcaattatgtaaagtatactcctctgaacaaaatttggagcatgtttgtttctctctacctgatttccccagaatctggaaactatctatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtg

SEQ ID NO: 19515 - DNA, 2332 bp, Homo sapiens
  ENST00000546893
gcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgta

SEQ ID NO: 19516 - DNA, 2599 bp, Homo sapiens
  ENST00000552197
gttgccgcagaggcctttaaacgcgtgggtcggtgccgggaggagagcgcatcttcgcccttgtgcgagccccttgccccctaaattatccacctcctggcgcatggggctccccagcacccactgggacccagtaggttacccggctgcctgggcaccgtttgcctgccaaatcgcccgcctgaggtttgtgctgaactgtagttagagaaggcacaagtgcatatggcagcaaaaggaatttcgcggtacccgcgtcacgccgctcccagtgcctttcacaggctgccttgggctggggaaggtggtgctacaattcagagtcctttgtcttgctctgcggcgcggacccggggtttgtacaaaccctcgttctctgttagaaacctaactgccgccaggatcacgtactttctcggacgaatccgcggtgatgtgtgtagcaaaagtgaaaaaagacgcctctgctagaaaacgatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttggctctttctcttcctccagtttccagtccagccctgttggctctcagaatgcatcatccttctccctgcagcgctctcactgaacatgctcaagcgcaaggaacttataatcttgtgttctctggattctggatttagtaatctgtattagtctgttctcacactgctaataaagaaatacctgaggttgcttccaagatagccaaataggaacagctctggtctgcagctcccagcaagatcgatgtagaagatgggtgatttctgcatttccaactgaggtacctggttcatctcactgggactggttggacagtgggtgcagcccatggaaggtgagctgaagcaaggtggggcgtcacctcacccaggaagcacaaggggtcaggggatttacctttcccagccaagggaagccatgacagactgtaactggagaaacggtacactcctgaccaaatactgcacttttcccacagtcttagcaactggcagaccaggtaataccctcccgtgcctggctcagtgggttccatgccaacggagccttgct

SEQ ID NO: 19517 - DNA, 543 bp, Homo sapiens
  ENST00000548979
tttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggtatgtctcttgccagccactctaacttttctgattagttttccatttaaatttacaaaataaatagtccacctctctatcaagactactttcagttgccttgaaaggaggcagaagccctgtagctttgctacttgggagatatttaaaatatcatatcagaatcttctcccatccctccaaatatcttttctggttttactctttttttttgagatggagtctcactctgtcgcccaggctggagtgcagtggccagatctcagctcactgtaagctccgcctcccgggttcatgccattcttctgcctcagagagtagctgggactacaggcgcccgcc

SEQ ID NO: 19518 - DNA, 1076 bp, Homo sapiens
  ENST00000549633
actgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccga

SEQ ID NO: 19519 - DNA, 586 bp, Homo sapiens
  ENST00000551506
gatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttg

SEQ ID NO: 19520 - DNA, 891 bp, Homo sapiens
  ENST00000550173
agttgcccctgctcccctccatgccgctccctcgtcccccggacttggagcgccccagctccgttaacctggacgcaccaggtccttcggtcgggaccacgtggggtctccaggccctccaagagctggcccccggctctttgcgcctaggccggtgctttctcggtgctcagcaaatccttctggttcacctcacacccagtccccaaagcagagctccacagggcagatctcaggaagggctgaccaggtctgcgggtgctggatccggaagaggggaggtgcctcccgcttcagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgttttta

SEQ ID NO: 19521 - DNA, 309 bp, Homo sapiens
  ENST00000546519
gcccagccagtgaaagggggctgtgtctgaaacaaagaccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaag

SEQ ID NO: 19522 - DNA, 1607 bp, Homo sapiens
  ENST00000612161
aggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttggctctttctcttcctccagtttccagtccagccctgttggctctcagaatgcatcatccttctccctgcagcgctctcactgaacatgctcaagcgcaaggaacttataatcttgtgttctctggattctggatttagtaatctgtattag

SEQ ID NO: 19523 - DNA, 4300 bp, Homo sapiens
  ENST00000374759
aagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 19524 - DNA, 1988 bp, Homo sapiens
  ENST00000539643
caggctggtctctaactcctgggctcaagcgatctgcctgcctccgcctcccaaattgctgggattacaggcgtgagccgccgtgcccaggcttattttcttacgtgcttgtcctagaacaactgaatgtgtaaagtggaaaaaacaaaaacaaaaccccacccagcccagataaccatctctgacattctggcacattccttttgactgttgctctggacactcacttccatgggcaacgagcaggcttgctggggtcctgccgggtgcgcctggggcacagccagtgggagaactgatgcggcacagtggctggctgtgcgggagaggccatcccgggtgggcttccaggggcagtcagggcgcagcctctcccgggccctcaggcctgcgtgcatcactgagctgtccgggcttcacggtcacagtcatgatgggtgtcaccagtggccagtgttcgggcacactccctgcaggtgacctgtgcgttgccttgctgtgggccgcgccgtccctggcccagcacggtgcatgagcagcccgggcactctgactgtgtgctttccaaacccagaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcagggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttca

SEQ ID NO: 19525 - DNA, 896 bp, Homo sapiens
  ENST00000540966
ggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggctgaaattaaaaagatagtagcagaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggct

SEQ ID NO: 19526 - DNA, 774 bp, Homo sapiens
  ENST00000576151
gggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaa

SEQ ID NO: 19527 - DNA, 2903 bp, Homo sapiens
  ENST00000542075
acatgcaccgcatctctgggtgcgccttggagccgggacttccctttgcccttctccggctgggccgtgggggaagcgcgggggtcaccagatgaccgctcggggcctgggagggaccctgctgagtcagcgccgtttctcatctgctgcagagaatcccgcggtcagggcggagagaatggcggctccttccgcattcggccgccccgtcgggaacgcatgctcctcatcggcaaggctcctcattagctgtccacgtggacaccacaagcccagggctctcgtcccctcccttcctgaagcaccatgctcgaaaggagtctccatttgtttctataaatcccaaccaaagggtgaaaatgaaagccctccgtcagagtccctctggtgcaggctgtggcgctcgggtacctgggaccggcactgaaccctctggggacctgcaagctctggccagcagcacggggttcggccgtgctgggctgtgggatgctgtttccagccggcccccagtggtcaccgggtgggaggactgcatcgcagggacttgtctctttgtctgttaaaaaatctgattgagtgaaagaagaacctgcctcctgtccttcccttgctctgtctttgtttcttgtagtttcatttgcagacagtagatccaaaaataacctggcagccagaatttgaaatacccctcatgccccggagaatctgggcccgtgggtttctgtgaaatcgcccttgacagcttggctcagtacctttgttctggacgagcttctcacgctgttggattgagtgttcctttttcttttgcactagcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggc

SEQ ID NO: 19528 - DNA, 1627 bp, Homo sapiens
  ENST00000573058
aaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggtgtcagcctgggctcgtgtcggaagacactcccctcttgggctggggaggctgggcaggggcagcagaatcgatggttcctccctcagtccccagtctctctccctgcaccagattagcatgcaaatggagcgggccccggcagctggtggggacaggaagaggctggtggctgacagctactgtaatatctgtcacacagttgtttgccagaccactaaatgtcaggtgccgcgctgtgctcgtgtgtctgggcgcacacggggggcggcgcggggggcgcctgacaggtaacacgttgttaagtgcccgtctaagagctgcttaggacagttcttgcattttaattgcgaaggcagttaccattggctcattgccacaagcctatgaggttgttaaatatttttttattgcttcgctagtaatcatcaggttgaatataaactgtgctgacgggggtgtcactttagaaacatctgccacttccttttgtcccgcccttgccttctgtcccccaaccccccaaaccctcccttgactttcctgcaaaaccttctgagtcttcaccgtgtgtgcaggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctc

SEQ ID NO: 19529 - DNA, 2708 bp, Homo sapiens
  ENST00000288439
gtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtca

SEQ ID NO: 19530 - DNA, 580 bp, Homo sapiens
  ENST00000546352
cctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtgg

SEQ ID NO: 19531 - DNA, 663 bp, Homo sapiens
  ENST00000543204
gcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcggctctgtaaatgtggatcgggctcttccataattccagcagcattaccttctccaccaaaatgacaagagcgagtgattcgtgcccggttggaacatggtaaccggctgaaaagagaggcgtaaatccggcgcagacgggaaaagaccatcggcatgcggggggctggcagagcggcccctgtagcgttagtgggcatgcattgagccaatcgtaaactaatgtgacagatgaaatttgttcataccgctgtgtttacacccacatgcgagatccaaatcgtcatttcccacttagcgtctctcttggcagctccatctccaccagaacgcgccccagtcttgctgtttaatatcccattatgatcggtgacagaagccgcattcttccgccacgtacctagttaccagttgccctttgtgtctgcgtgtttgcatatttagaaataaatctgcagctggg

SEQ ID NO: 19532 - DNA, 528 bp, Homo sapiens
  ENST00000539748
cgcgactgcccatccaaaccgaggcctcgcggggcgagtcccttgtcctccagctcgttgaactggggccccgggcacaggtcggctggaccagcttggcgaaccggacagctgcgagaccctcagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtg

SEQ ID NO: 19533 - DNA, 423 bp, Homo sapiens
  ENST00000540233
cggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctgggtccacacaagcttcctcttctaaactcagaccaagacagccgtcctcaccgtgctggtgcagacctgctctctctgtgtctctcctggacaccagatgccttcctgcggagctgcctgcagagagccttgctgttctccccaactcggaattccatggaggaagctcctcaggcctgggctgttgctggagttcagtggctcctctcccagt

SEQ ID NO: 19534 - DNA, 2659 bp, Homo sapiens
  ENST00000595796
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctgga

SEQ ID NO: 19535 - DNA, 2100 bp, Homo sapiens
  ENST00000619100
ccgctcttcggcccagtgactgccctccctggctgctcccctcccggcctgcctttctcctccagctgttcttcctcctccagcactccccatcctcagcctatccccacccgcagcgtctcccctccccagctgttttacctctggtggctgcttcaccctcccccggtcctctccacttccagctgctccctccaaagtttgtcctagtttcccccttcccagctctccccattcgcagcctcttccatcttcaactcttcttccctgctagcctcttccctcctccgatggtctctccttggcttctctccaccccgcttgcttcttctctagtctttccctggccctggcattagtctccttaccctgtgccctgtcccaatgtgtgcccgggctttgctccttgcgtgcagttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctg

SEQ ID NO: 19536 - DNA, 493 bp, Homo sapiens
  ENST00000497336
gtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgaggggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctacc

SEQ ID NO: 19537 - DNA, 797 bp, Homo sapiens
  ENST00000615300
tcactgtgcatgtatgtatgggtttctggggcattggtcctggtgctctctccacatcctgcatcccgtaccctctgtctcatggcccaggcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagag

SEQ ID NO: 19538 - DNA, 894 bp, Homo sapiens
  ENST00000480105
ggctggggctagggctggggggagggggaaggcctggggcaggagcctctgagctctttccttctgtgaccacggacctgtcagtttccaaacagaaggtgtgcctcacttgtgtggattttgtcactgtgcatgtatgtatgggtttctggggcattggtcctggtgctctctccacatcctgcatcccgtaccctctgtctcatggcccaggcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggtaagcattccagggcagagctagggagagagggagcactccaaggagggagtgctcactccaggatggctggaggtgaaagggacatgcataggagggggctgggagagcatctgaaagaatggtctggaagaatgaaggtgattgtctaggaaggggcagaggagacagagcaccagcagggtccaggaagacagggagcactcaaacagaggctggcatagagggagcattctccagacagatggaaagagcactattgggaagagagctggaagcactttgaagaaggaggatggaggaacgtattctgtca

SEQ ID NO: 19539 - DNA, 525 bp, Homo sapiens
  ENST00000494034
ggccctgctgctgtgcattgcgcttctgtcgtcctactccatccacctcctgctgacctgtgctggtattgcagggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccgcgcaggatgcaggccgtggccaacgtgtccattggggccatgttctgcatgtatgggctcacagcaacctttggatacctcaccttctaca

SEQ ID NO: 19540 - DNA, 910 bp, Homo sapiens
  ENST00000440085
agacagcgtgagtctggggtctgggaggagaggctatcccttctccacgtggtcggctcatctgcgctggggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctata

SEQ ID NO: 19541 - DNA, 871 bp, Homo sapiens
  ENST00000441948
cgtctggggcaggggtctccgagtctgtccccaaccctcagctcactcaacaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccacc

SEQ ID NO: 19542 - DNA, 741 bp, Homo sapiens
  ENST00000413668
ggccacgcggtgagggtggagggaaggagagggggtggcgcgggggaccggggaatgaaagacacagatggcaagagagacagcgatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaact

SEQ ID NO: 19543 - DNA, 708 bp, Homo sapiens
  ENST00000416711
tttctgagatacctccttcccaaggagtaagcgcgggagggagctggggtttcttcagagacgctgtacctacaagacaggggctccaggctcgggtggggattgcagagacacccccaccccaggaaactcggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgg

SEQ ID NO: 19544 - DNA, 622 bp, Homo sapiens
  ENST00000488083
acacaaacaaaccgctgtctccctccaagaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgaggg

SEQ ID NO: 19545 - DNA, 656 bp, Homo sapiens
  ENST00000429543
ctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgaggg

SEQ ID NO: 19546 - DNA, 1993 bp, Homo sapiens
  ENST00000620913
acaaatgccctccctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctgga

SEQ ID NO: 19547 - DNA, 2100 bp, Homo sapiens
  ENST00000622196
ccgctcttcggcccagtgactgccctccctggctgctcccctcccggcctgcctttctcctccagctgttcttcctcctccagcactccccatcctcagcctatccccacccgcagcgtctcccctccccagctgttttacctctggtggctgcttcaccctcccccggtcctctccacttccagctgctccctccaaagtttgtcctagtttcccccttcccagctctccccattcgcagcctcttccatcttcaactcttcttccctgctagcctcttccctcctccgatggtctctccttggcttctctccaccccgcttgcttcttctctagtctttccctggccctggcattagtctccttaccctgtgccctgtcccaatgtgtgcccgggctttgctccttgcgtgcagttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgaggggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggcagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctg

SEQ ID NO: 19548 - DNA, 4549 bp, Homo sapiens
  ENST00000570101
ccccaaggtaggtggccggagacaggctctggagggtggaagtgttagatccccgaggtctgtggagcccctcagtccccgccaccgcggaaaagctcagaccctttccctgcaggggtccagatcctggcgtcctcgccccacgcccgtccctctgttgcgccagctctgccgcgcctttacccagccagagggtctccacccagtcctaggccgggatcgggtcccggagctcctccccaggttaccccacagtagcccacccttctcgctccaggcctgggaatcgccccgccccggcctcctggcccgggtgcgccctggctcacctcacaaagcctcacctcacaaagcagcccaccctttctatctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaaggcagggctgggcgcagtggctcacgcctgtaatcccagcactttgggaggccaaggcgggcagatgacttgaggtcaggagttcgagaccagcctggccaacacggcaaaaccccatctctactaaaaatacaaaaaattaaccgggcatggtggcgggcacctgtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcacttcactgtgtagctcagtctctcccacgcacataattggggacagtgggggctctcttaccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctga

SEQ ID NO: 19549 - DNA, 4392 bp, Homo sapiens
  ENST00000219320
ctgattaaaaaaaaactccagtgctctggccatgggcgtgaaggcaaggacagagaccgggaggataatgaggccaaacagctttggcccaccgccaccgggactggcaaagaggccagacctcctaatgctcttccttggaggaaggagcagtgtttgatttggtcaagaggccaagactaaaagtaagaggataaacacgagctggctggacgcgaggctggctcagggcagtgctgtcgggctgaggattcagggagctggtgttgtccaagcttcacatttgcggaaactacaactcccagcgtgtcccgcggccgcccgagcgggcgtcatgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaaggcagggctgggcgcagtggctcacgcctgtaatcccagcactttgggaggccaaggcgggcagatgacttgaggtcaggagttcgagaccagcctggccaacacggcaaaaccccatctctactaaaaatacaaaaaattaaccgggcatggtggcgggcacctgtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcacttcactgtgtagctcagtctctcccacgcacataattggggacagtgggggctctcttaccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctga

SEQ ID NO: 19550 - DNA, 2867 bp, Homo sapiens
  ENST00000564100
cggagacaggctctggagggtggaagtgttagatccccgaggtctgtggagcccctcagtccccgccaccgcggaaaagctcagaccctttccctgcaggggtccagatcctggcgtcctcgccccacgcccgtccctctgttgcgccagctctgccgcgcctttacccagccagagggtctccacccagtcctaggccgggatcgggtcccggagctcctccccaggttaccccacagtagcccacccttctcgctccaggcctgggaatcgccccgccccggcctcctggcccgggtgcgccctggctcacctcacaaagcctcacctcacaaagcagcccaccctttctatctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaa

SEQ ID NO: 19551 - DNA, 1806 bp, Homo sapiens
  ENST00000566598
aagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatga

SEQ ID NO: 19552 - DNA, 1437 bp, Homo sapiens
  ENST00000564010
atgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaa

SEQ ID NO: 19553 - DNA, 646 bp, Homo sapiens
  ENST00000566953
agcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggtaccttcctctggaaactggggttgaggtcatttccccaccatgacggtgcccttcacctggacagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataacc

SEQ ID NO: 19554 - DNA, 1921 bp, Homo sapiens
  ENST00000562149
agccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcggtgagcccccttccactccccagggcccctcctagcccctgtgagcgcttccaacatggtcctttggccttgtgtggaccccatcctgtagaaggagaaactgaagcctgtagaaaagagtcggtgcctaggatgggtccctacatatcccaggccaggtgtcagaagcgccctttgtcctggggtcaccagaacattccgtgagtcctgtaagaatctctatccatggcatggcacggtggctcacgtctctaaacccagcactttgggaggctgaggcagaaggatcgcttgagcctgggagttcaagaccacctgggcaacctagtgagaccccatctctacacaaaataaaataaatagccaggtgtggtgggatgcacctgtggtcccagctactcagccacttgggaggctgaggcagaaggatggctggagcccaggagttcaaggctgcagtgagccaagattgcaccactgcactccagcctgggtgagagagccagaccctgtctcaaaaaaac

SEQ ID NO: 19555 - DNA, 873 bp, Homo sapiens
  ENST00000569209
acttctcaggcgtttcctgagtctgcttggcatagtctccggttcattcagtggacacttgtggtcgctagagctgaaggtggatgtccctaggggtggaatcagataagaggcagctggggatgaggacacttagtctctccttcccggcagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcaggtgccagtgccagttgcaaggtccctgctgtccccttagatcaccccaccctgggatggaacccagcaaggaggaggaacccaggcagaatggaggaaatcctggggggaaggatggaacaggggcctcaggacttgccccttgttcctggggtctttgttcccaaggtaccttcctctggaaactggggttgaggtcatttccccaccatgacggtgcccttcacctggacagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcggtgagcccccttccactccccagggcccctcctagcccctgtgagcgcttccaacatggtcctttg

SEQ ID NO: 19556 - DNA, 760 bp, Homo sapiens
  ENST00000565785
catcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacagcagagacaaggtctcactatgttgcctagcctggtcttgaattcctgggctcaagcaattctcctgcctcggcctcccaaagtgctggggttacaggcatgagccaccaacccagcctaaaatggggaaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcg

SEQ ID NO: 19557 - DNA, 546 bp, Homo sapiens
  ENST00000570214
atgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatgggg

SEQ ID NO: 19558 - DNA, 564 bp, Homo sapiens
  ENST00000562397
agccggctcgggaaagaatcccccaaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttgg

SEQ ID NO: 19559 - DNA, 582 bp, Homo sapiens
  ENST00000563196
atgtgatgcatgctcacgtgtctccgcagccggctcgggaaagaatcccccaagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggtttt

SEQ ID NO: 19560 - DNA, 731 bp, Homo sapiens
  ENST00000564391
aaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatggtgagtgcactggccgggagggcagaggtgcagttcagttgggcgctttgcctcaaaagggaggcttcgggtcagggatggccagtaagtgatacacgcactgctctcccctccctcacacatggcagacatgactaatctattctagtattctttcctgtgacccaaatgaggcttcagaagccttccaacaatcagagaaatttgaacatcaattacatctctaattttttaggtgtaacattga

SEQ ID NO: 19561 - DNA, 581 bp, Homo sapiens
  ENST00000564720
atgtgatgcatgctcacgtgtctccgcagccggctcgggaaagaatcccccaagctccatttcatgagtaagcgtgagagccgctcagtttcctccagctctggttttgatcagtgttctgctccctgcttgcttagggctggagagtctcaggcatggtggtggtgggcaacatgggaaggggcatctgcagaaataacagcagcagtgaccatttattgagtcttaaacccttactgatattaacacacgacccacaggaacatatgatgtaaaggcctaaaggggcgaagtgacttgcccagggtcacacagataggcagcggaggagtcagcattctgacggcagaacctactcggagacccagatcacagccctgcccagggctgctcttgatctgggggtggacttgatgctttaggaccatcatttctctgcgggtctcaggctatgagctgaaccttgagaacactgaagatcctttttcagggctgggctcctcagagcctctcgagattcttggaagaaaaaaaactgcatctcaattgtgtttatccagagagcaaagagaatcagtcag

SEQ ID NO: 19562 - DNA, 562 bp, Homo sapiens
  ENST00000567930
agcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggaacatatgatgtaaaggcctaaaggggcgaagtgacttgcccagggtcacacagataggcagcggaggagtcagcattctgacggcagaacctactcggagacccagatcacagccctgcccagggctgctcttgatctgggggtggacttgatgctttaggaccatcatttctctgcgggtctcaggctat

SEQ ID NO: 19563 - DNA, 567 bp, Homo sapiens
  ENST00000564964
atgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggtaaggtgcaacaatgagctgagtaatttgccagtgagcagtgggggtgccgagaggtcttaaccaaggcagagaatctgcaagaggtgggacccccagcttctgagttccacgaggaccccagcctgcactctcatgtgggtggcaggagaggctggaggatggtgcaggactcgggcaggggtgcccaagggaaacattttggttggagagtcaggaagccgcaccaagccttgtgaccttggacgaatcactctgtagacctctgtctctgtgacgtgagcagcgg

SEQ ID NO: 19564 - DNA, 2639 bp, Homo sapiens
  ENST00000377374
aaataatcctctctagctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaata

SEQ ID NO: 19565 - DNA, 2725 bp, Homo sapiens
  ENST00000377371
gtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaata

SEQ ID NO: 19566 - DNA, 2461 bp, Homo sapiens
  ENST00000539911
ttgttaccttcagagcagctctctccatagcaactgaaaacttttctgggctgaaataatcctctctagctcccagtgcacagtcaaagaattttaaaaacagggaactttgtaactgtgaaatactctccaggatttaaaaggctgtggagctccagataaagaatcgtttatctttcttctgaagtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagcagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaatatggtg

SEQ ID NO: 19567 - DNA, 2808 bp, Homo sapiens
  ENST00000377369
ttgttaccttcagagcagctctctccatagcaactgaaaacttttctgggctgaaataatcctctctagctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagcagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaatatggtg

SEQ ID NO: 19568 - DNA, 4997 bp, Homo sapiens
  ENST00000367137
ccaccggcagccaaccagttgggcccgagtccgcgggcaagaagcgattgggggcgcgtgagctcggctccccggtcccccgtccgggtgcccccccgccgggcccgaagcgatatatcctgccctccccggccacctcccccgcgtggaagcggagcggcggcctcgctgtaacgcagaagcgaaatgtagcgagccgggtgtcgcggctggacgctcgccttggctgggggtgtgggggggcacgccgggggccaaggaggactgtcgaggaggagtgatgagaagagggggtgccctgcaccccccgagaccacgggccacgctgccacttgccaggcgccccccttcctcccaggcgaggggcaggtgttccacactgattctcgtgactttaaggaccagggatttgaagaggtattagctcttcccaggaagggaggaagtttctggaagagaagggaaagacggcagacgctgcgctgggaccagcagagcctgaggagctgtgggaagctgacagagcccagccaaaggagcgggaaggagccgcagccccaggctggcactgtgttctgaaagatttgaactcaagctgctttttacggaagaggggccacttcagagggcaccccagaatttggttgagctcttctactctggatgccccctgctctgaggagcctgccactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaggagtggagagccgtgggaagaggtcctgcggcgcccaagcctgggttcaccccaagactaagttctttcccaagttagagaagaagagagaaagcaaaaagaagagaggaaagttctcccttcccctcctccgtgcctgtcatgtcctctaagccagagccgaaggacgtccaccaactgaacgggactggcccttctgcctctccctgctcttcagatggcccagggagagagcccttggctgggacctcagagttcctggggcctgatggggctggggtagaggtggtgattgagtctcgggccaacgccaagggggttcgggaggaggacgccctgctggagaacgggagccagagcaacgaaagtgacgacgtcagcacagaccgtggccctgcgccaccttccccgctcaaggagacctccttttccatcgggctgcaagtactgtttccattcctcctggcaggctttgggaccgtggctgctggcatggtgttggacatcgtgcagcactgggaagtcttccagaaggtgacagaggtcttcatcctagtgcctgcgctgctggggctcaaagggaacctggaaatgaccctggcatcaaggctttccactgcagccaacattggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtatgatcatgattggagtcatcattggctctcgcaagattgggatcaacccagacaacgtggccacacccattgctgccagcctgggcgacctcatcaccttggcgctgctctcaggcatcagctggggactctacctggaactgaatcactggcgatacatctacccactggtgtgtgctttctttgtggccctgctgcctgtctgggtggtgctggcccgacgaagtccagccacaagggaggtgttgtactcgggctgggagcctgttatcattgccatggccatcagcagtgtgggaggcctcatcttggacaagactgtctcagaccccaactttgctgggatggctgtcttcacgcctgtgattaatggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccaaatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatttattgagtgcctactatgtgttaggtactgtgccaggcactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcacattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttatttaga

SEQ ID NO: 19569 - DNA, 3777 bp, Homo sapiens
  ENST00000468057
ctcttcacagctgagacaacagagaaactggactgaaggcaaaggggccagggattgcaatttgaggggggattgcaaaggatttctggggtgtcaggcagcccagggcagctcagctgtgtgggtccccattacccttccccacccacctccaggaaaacagaaaagcactgggaagtcttccagaaggtgacagaggtcttcatcctagtgcctgcgctgctggggctcaaagggaacctggaaatgaccctggcatcaaggctttccactgcagccaacattggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtatgatcatgattggagtcatcattggctctcgcaagattgggatcaacccagacaacgtggccacacccattgctgccagcctgggcgacctcatcaccttggcgctgctctcaggcatcagctggggactctacctggaactgaatcactggcgatacatctacccactggtgtgtgctttctttgtggccctgctgcctgtctgggtggtgctggcccgacgaagtccagccacaagggaggtgttgtactcgggctgggagcctgttatcattgccatggccatcagcagtgtgggaggcctcatcttggacaagactgtctcagaccccaactttgctgggatggctgtcttcacgcctgtgattaatggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccaaatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatttattgagtgcctactatgtgttaggtactgtgccaggcactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcacattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttatttag

SEQ ID NO: 19570 - DNA, 2221 bp, Homo sapiens
  ENST00000484228
aacgaaaagaagtttatttagctcacagttctggaagctgggaagttcaagattgagcagctgcttctagtgagggcctcatgctgcatccaaacatccaaatggagaaacagaaggaaaactgggcatgtgcaaaatgggcaaaacaagagaggcaaacctcgctttatgacaacccactctcatgggaactatacctttcccaagaaagacattaatccatcttaataacctattcactcttaaaggcaccacctcccaccaccacatttggggaccaagccacaacatgagttttgttggggacaaactatattcaaaccatagtaacgagggaatagcattataggagtccagtgaaagctctgtctttgcccccaacatggggaagccaatgctgaaaagcagggagggattgggaaagaaatacctgatctctctctccacctgccctctggttgcctgctgttgcctcccactgaacaaacagtggaagcagccagcaagggagactgggtaatgcagtctgtggagaccagtcccccagagctcagagcaaggctgagaagagcagggagcaggttgggatgtgagggcaacagagaaatcagcacaggtcctggcggagataccagattccagagtttggagctcaaacctgatccttgaaactggttaccagaatcagcatatgaccataggatgcctgggtctgctcagagcattggagaggaggtgaggcggtgaggcaaggcagggcttcatcccctcagctgtgtaggaaggcaggtgcccatgctctactggtggagaagtcaggctctctgagtctgcagatctgcacgtatcctttccggcactgtcacagctttgccaggggaacatggaactgctgcatctccatagaggggaggatgggggaggctggaagatgcactggaagcaggggtctttgtcttccttcttagtgccttactcttcttttggggactggtgaatgggtgatgcccacatagaccctaaattaagacagaggacagtgcctctatagatagaagacaaagagtgagaagatcattttgttcccactcctccctctgacctctgtctgtgtctaagcccgtatgtgtctctgcaggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttc

SEQ ID NO: 19571 - DNA, 843 bp, Homo sapiens
  ENST00000484000
gaacgcggaatctggagggagcctaaagtgacgagccggcgggagaagagcaaggtgttccacactgattctcgtgactttaaggaccagggatttgaagaggtattagctcttcccaggaagggaggaagtttctggaagagaagggaaagacggcagacgctgcgctgggaccagcagagcctgaggagctgtgggaagctgacagagcccagccaaaggagcgggaaggagccgcagccccaggctggcactgtgttctgaaagatttgaactcaagctgctttttacggaagaggggccacttcagagggcaccccagaatttggttgagctcttctactctggatgccccctgctctgaggagcctgccactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaggagtggagagccgtgggaagaggtcctgcggcgcccaagcctgggttcaccccaagactaagttctttcccaagttagagaagaagagagaaagcaaaaagaagagaggaaagttctcccttcccctcctccgtgcctgtcatgtcctctaagccagagccgaaggacgtccaccaactgaacgggactggcccttctgcctctccctgctcttcagatggcccagggagagagcccttggctgggacctcagagttcctggggcctgatggggctggggtaga

SEQ ID NO: 19572 - DNA, 7430 bp, Homo sapiens
  ENST00000634102
agaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagattctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcaggctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggtggctcacgcctataatcccagcactttgggaggccaaggcaggaggctcacctgaggtcaggagttcgagaccatcctgaccaacatggagaaaccccgtctgtactaaaaataaacattaatcgggcgtggtggcgtgcgcctgtaatcccaactactcgggagcctgaggcaggagaatcgcttgaaccggggagacggagattgccgtgagtcgagatcgcaccattgcactccagcctgggcaacagagcgaggctccgtctcaaaaagaaaaaaaaaaagagaacgagataaacatgcccactcctgagaacactcgttttgtgatgttagtggttattctgattttcaagaaagtattatagtcaagtttgggaaaggctgagttaaaagtcaagcctgtttccttacagccagcactgacagcactttgccaacgctcatgagctccgtggctcctcaggagcgggtgtgctgtgctgccgaggaacggctcgaaccatcagagccaccagcctccacgtgcggctccatgatcacccccagcagaggctcccgggtgctggttccaaatggagactccaggtcttgccgctgaccggtgactctgctgccagcatttgagacccgccatcacacaggagttgcagattcggagaaaccctaactagccagggtgctgccagctgggaaaaggccgcctttttttttttttttttttttttgagttggggtcttgctctgccatccaggctggagtgcagtggtgcaactgatagctcaccacggcctccaactcatgggctcaagggatcctcccacctcggcctcctaagtatctgggactataagtgtgtgccaccatgcctggctaattttttttttctttttcataaagatgaattcttgctattttgcccaggctggtctggaactcctgggctgaagcaattctcccacctcagcctcccaaagtgctgagattacaggcgtgagtcacaatgcctagccaaaaagccagtcttgagatggggaagacgtggcccgtgctgtccccagcagtgcccagtcccagccaaagtgggcagtgctgcctcactctcccacccaccctcagggtgtggcacttactgggaagaagcaggcattgagaaacagaattgagggggggaaacagtccagggccaacagtgcttggggattgaggcctgaaaatgcgagcagggtacagaggctgtggctggccagatgggtcgggtgccccctgcactcccaccccctagtcaggggtcacccatcctactttgccttgtgtggagctgacaggtgacatgttttcctattgttgtccttgacttgataacaatctgggagttaaacacatatgatcatccctgctttacaactgaaaaacgaggcctagagatactatcatcatatacacctgaaaaacgaggcctggagcgatggaggagcttgttcaaggtcagagccagcactcatatatgggtcttaagacactggagcagccaagggcctctagaccaggacattccactcggagcagcagctcaggggccaccaggcctctgtggcagggggacctctgtggcaggggggacctctgtggcggggggggggcctctgtggcaggggggtcacagcccaaggaaggggagcaggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacagctgatcaaaggagcaggcaccagtggccgggcctcccgtctgcccctcatcctccaggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggttgcaggccctggtggatcctttctgttttgctccatccccgtcccctcttgcacccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgtgctccttaagttagccatcctcaccccctccgggcagctctgagactgagccagggccactagcagcacccagacctcgacccttctcagaccgaggcgccaccaccccaggccgaggaggcaaggagggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaacaatggtagcatcgttttcagtgcccaggaagaaggcagctgggacagggaaagggccaccacaccacacccaagcccatacaacaggagagccactttcagcagctctgagcaggacagacttgtggccaagtcaagaaagtaaggtctggtcccagcgaggtggctcatccctgtaatcccagtgctttgggaggccgaagcgggggcggggtggatcacttgaggtcaggggtttgagaccagcctgaccaacatggtgaaacctcaactctactaaaaatacaaaaattagggccgggcgcagtggctcacgcctgtaatcccagcactttgggaggctgaggcgggcggatcacaaggtcaggagatcgagaccaacgtggctaacacagtgaaaccccatctctactaaaaatacgaaaaaaaaaaattagctgggcgtggtggtgggtacctgtagtcccagctacttgggaggctgaggcaggagaatggcatgaacccgggaggtg

SEQ ID NO: 19573 - DNA, 3261 bp, Homo sapiens
  ENST00000612931
gtcagggtccctgggagaggcagccctcggatctgcccctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgagccggccgcgggctcggggtgtcccaggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagtgatggccacggttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaata

SEQ ID NO: 19574 - DNA, 1658 bp, Homo sapiens
  ENST00000382147
acctgtgagtgtggtggtgagtcaggaaacagctccggcttcctgcttggcagcaaagctggtccttcccctcctggggtccttcccctccgccagccctcgaggcccgcgctagggcgctctgctcagcgctcagccctcactccggcaccgcggcttcgaacagccattatgcgcagctgagaccggtggaggcagggaagctggggacggagtgagcgagagggggaatgtggggagtgacccagatgtcaggatgacctacgggagtccacaggcaaatgcaagcccatccgatgctgtggcgctggaccatggggaggtcagccgaaggcaacagcaggagctgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtct

SEQ ID NO: 19575 - DNA, 574 bp, Homo sapiens
  ENST00000632441
aaatacaaaaattagccgggcatggtggcgtgggcctgtaatcctagctactccgaaggctgaggcaggagaattgcttgaatccaggaggcgaagcttgcagtgagccaagatcacgccactgcactccagcctgggcgacaaagcaagacttcttctcaaacaaaacaaaaaacaaaacaaacaaacaaacaaaaaatgactgtgttaacgactggcttgcaaaatttctgaaaattcacaattggctccggaggatggggttgatccaactccaggctgacactgcccctggggtgagggcccccaggaattggagggcgggggctgaggggacggtcccttaaggccttatgcccacagtcgccttttcctcccccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccct

SEQ ID NO: 19576 - DNA, 565 bp, Homo sapiens
  ENST00000633495
aagatttgggtgaacttgaagccagtggtgaagtgaggctttgccatgtgccagctcaggcacacgctgctacttctctccccgtcgtcttagctcagccttcacagagcactgcagcatatggatggccatcttcttgtacccgagaccccctccgagagtcacactcagcttgccactgagaagggccggggagtgtccgtagtgctggtccagccccgacacagtccctaaaacgtgcctgggtggcttctgagtcttgcgtcagtttacctgctgcgacgcttgaggcctgacttctcaggagcacccggcttcctccggggagccctcccacccctgcacgttctgtgtctccacagaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctg

SEQ ID NO: 19577 - DNA, 2074 bp, Homo sapiens
  ENST00000616586
gcaggccaggactagttccacggccctgagcatgcgttagccccttcttgcctccatgcctcagtttacctcggagtgagctgcgggagacgtctccctgcctggccggggcggctctgtcgtagcggagggcagcggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccagtgcgtaggcagggccggtgccccggctcccagcccgcagcccctgcagaaagaccccagagctgcatgtcaggcacagggtgggtgggacagagggagagagcaatgcactccagctgctcccggagcccttagagagactcactcattcagctcagcatgcgtttcaactgctcccctctttatggaaattgtttggaatgcaatggaaatgctaaagtttgaggccaggtgcggtgactcatgcctgtaatcccagcactttgaaaggctggggtaggaagatcacttgaggccaggagttggagaccagcctgggaaacatggccagcccccactccccgtctctacaaaaaatttaaaaattggccagggagggtggttcatgcctataataccaacactttggaaggttgaggtgagtgaattgcttgagcccaggagttagtgaccagcctggccaatgtggtaaaacccggtctctactaaaaatacaaaaaattagccaggtgcggtggcggcgcgcgcctgtaatcccagctactcaggaggctgaggcgcgagaattgcttgaacccgggaggtggaggttgcagtgagccgagatcacgccattgcacttccagcctgggcaacagagcaagactgtctcaaaaagaaaaaacaataaagaa

SEQ ID NO: 19578 - DNA, 2030 bp, Homo sapiens
  ENST00000632428
cagtgttttcttcttggggtcggaataaaagggctggaataaaagagggcagaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccagtgcgtaggcagggccggtgccccggctcccagcccgcagcccctgcagaaagaccccagagctgcatgtcaggcacagggtgggtgggacagagggagagagcaatgcactccagctgctcccggagcccttagagagactcactcattcagctcagcatgcgtttcaactgctcccctctttatggaaattgtttggaatgcaatggaaatgctaaagtttgaggccaggtgcggtgactcatgcctgtaatcccagcactttgaaaggctggggtaggaagatcacttgaggccaggagttggagaccagcctgggaaacatggccagcccccactccccgtctctacaaaaaatttaaaaattggccagggagggtggttcatgcctataataccaacactttggaaggttgaggtgagtgaattgcttgagcccaggagttagtgaccagcctggccaatgtggtaaaacccggtctctactaaaaatacaaaaaattagccaggtgcggtggcggcgcgcgcctgtaatcccagctactcaggaggctgaggcgcgagaattgcttgaacccgggaggtggaggttgcagtgagccgagatcacgccattgcacttccagcctgggcaacagagcaagactgtctcaaaaagaaaaaacaataaagaa

SEQ ID NO: 19579 - DNA, 915 bp, Homo sapiens
  ENST00000633994
gggcagaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatggggg

SEQ ID NO: 19580 - DNA, 556 bp, Homo sapiens
  ENST00000634196
gtccggcctgtttatgctgcagccagggggctgaaagagagagagtcacgggcttccctgtgtgactgaggctgcgtggaggcactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgc

SEQ ID NO: 19581 - DNA, 567 bp, Homo sapiens
  ENST00000633255
actccggcaccgcggcttcgaacagccattatgcgcagctgagaccggtggaggcagggaagctggggacggagtgagcgagagggggaatgtggggagtgacccagatgtcaggatgacctacgggagtccacaggcaaatgcaagcccatccgatgctgtggcgctggaccatggggaggtcagccgaaggcaacagcaggagagctgtggttcctgccagaggacacttccctcgttggctatgcccaggagcagcttgaccagaagattttccctgttatgaagtcataacacatatcataatactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttg

SEQ ID NO: 19582 - DNA, 623 bp, Homo sapiens
  ENST00000631603
agccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaac

SEQ ID NO: 19583 - DNA, 489 bp, Homo sapiens
  ENST00000632084
ttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcaggtcagtgtgggtcccttagggggcagggagtgggcaggtggaccccctgggctgagttccccacagaagggtatcctggtcgtacctgatatcaggtgtactgtggagctccctgaaggccctccagaatggagttcctaccccgtccgccaccgaatcagcaggtactgtggtcctcgccgtgctccagtaccga

SEQ ID NO: 19584 - DNA, 3011 bp, Homo sapiens
  ENST00000613070
agaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagtgatggccacggttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggt

SEQ ID NO: 19585 - DNA, 8136 bp, Homo sapiens
  ENST00000301335
agaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagattctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcaggctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggtggctcacgcctataatcccagcactttgggaggccaaggcaggaggctcacctgaggtcaggagttcgagaccatcctgaccaacatggagaaaccccgtctgtactaaaaataaacattaatcgggcgtggtggcgtgcgcctgtaatcccaactactcgggagcctgaggcaggagaatcgcttgaaccggggagacggagattgccgtgagtcgagatcgcaccattgcactccagcctgggcaacagagcgaggctccgtctcaaaaagaaaaaaaaaaagagaacgagataaacatgcccactcctgagaacactcgttttgtgatgttagtggttattctgattttcaagaaagtattatagtcaagtttgggaaaggctgagttaaaagtcaagcctgtttccttacagccagcactgacagcactttgccaacgctcatgagctccgtggctcctcaggagcgggtgtgctgtgctgccgaggaacggctcgaaccatcagagccaccagcctccacgtgcggctccatgatcacccccagcagaggctcccgggtgctggttccaaatggagactccaggtcttgccgctgaccggtgactctgctgccagcatttgagacccgccatcacacaggagttgcagattcggagaaaccctaactagccagggtgctgccagctgggaaaaggccgcctttttttttttttttttttttttgagttggggtcttgctctgccatccaggctggagtgcagtggtgcaactgatagctcaccacggcctccaactcatgggctcaagggatcctcccacctcggcctcctaagtatctgggactataagtgtgtgccaccatgcctggctaattttttttttctttttcataaagatgaattcttgctattttgcccaggctggtctggaactcctgggctgaagcaattctcccacctcagcctcccaaagtgctgagattacaggcgtgagtcacaatgcctagccaaaaagccagtcttgagatggggaagacgtggcccgtgctgtccccagcagtgcccagtcccagccaaagtgggcagtgctgcctcactctcccacccaccctcagggtgtggcacttactgggaagaagcaggcattgagaaacagaattgagggggggaaacagtccagggccaacagtgcttggggattgaggcctgaaaatgcgagcagggtacagaggctgtggctggccagatgggtcgggtgccccctgcactcccaccccctagtcaggggtcacccatcctactttgccttgtgtggagctgacaggtgacatgttttcctattgttgtccttgacttgataacaatctgggagttaaacacatatgatcatccctgctttacaactgaaaaacgaggcctagagatactatcatcatatacacctgaaaaacgaggcctggagcgatggaggagcttgttcaaggtcagagccagcactcatatatgggtcttaagacactggagcagccaagggcctctagaccaggacattccactcggagcagcagctcaggggccaccaggcctctgtggcagggggacctctgtggcaggggggacctctgtggcggggggggggcctctgtggcaggggggtcacagcccaaggaaggggagcaggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacagctgatcaaaggagcaggcaccagtggccgggcctcccgtctgcccctcatcctccaggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggttgcaggccctggtggatcctttctgttttgctccatccccgtcccctcttgcacccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgtgctccttaagttagccatcctcaccccctccgggcagctctgagactgagccagggccactagcagcacccagacctcgacccttctcagaccgaggcgccaccaccccaggccgaggaggcaaggagggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaacaatggtagcatcgttttcagtgcccaggaagaaggcagctgggacagggaaagggccaccacaccacacccaagcccatacaacaggagagccactttcagcagctctgagcaggacagacttgtggccaagtcaagaaagtaaggtctggtcccagcgaggtggctcatccctgtaatcccagtgctttgggaggccgaagcgggggcggggtggatcacttgaggtcaggggtttgagaccagcctgaccaacatggtgaaacctcaactctactaaaaatacaaaaattagggccgggcgcagtggctcacgcctgtaatcccagcactttgggaggctgaggcgggcggatcacaaggtcaggagatcgagaccaacgtggctaacacagtgaaaccccatctctactaaaaatacgaaaaaaaaaaattagctgggcgtggtggtgggtacctgtagtcccagctacttgggaggctgaggcaggagaatggcatgaacccgggaggtgaagcttgcagtgagccgagattgtgccactgcactccagcctgggcgacagagcaagactccgtctcaaaaaaaaaaaaaaaaaaaaaaaaagtaaggtctgtatctgctgaccccacccttctccgaagccctctccgagcaaagccttaagaaactcttctctcgttcacttttcttttgtggctttcacgttttggtaagacttggccaaatagctgctcgagataatcaatcactggtggacaagtttctgctgagtgaggtttctgctgagtggggcgactcaaggcacggtcacgtaggcagcacctgtacaccgcatcctcatacagctgcgggaccgtgcctctgactgtgtgcgtgtgtgtttatctaagtgtgagatgcatccgggcatgtcagggtgtgtacatgttgggaagactgtgtagatttcttgtgtgccgctctctgaatggaggagaggggaagcgtcttacctcgctgaatccctttccattgctggaaagaacacctgggcaggagcggccccaagaccccgcccaggccctcggaagggagcctgaagggttaatccgtaccctgtattaaccagggtcaacccagcggctgacccgcctcttccctgctcctttgccgtttctagcacctggcttacttcctggcacacagtgagcactcaataaatgtatgctgagaatgac

SEQ ID NO: 19586 - DNA, 3261 bp, Homo sapiens; identical to SEQ ID NO: 19573
  ENST00000571650

SEQ ID NO: 19587 - DNA, 1658 bp, Homo sapiens; identical to SEQ ID NO: 19574
  ENST00000412517

SEQ ID NO: 19588 - DNA, 574 bp, Homo sapiens; identical to SEQ ID NO: 19575
  ENST00000576537

SEQ ID NO: 19589 - DNA, 565 bp, Homo sapiens; identical to SEQ ID NO: 19576
  ENST00000576769

SEQ ID NO: 19590 - DNA, 2074 bp, Homo sapiens; identical to SEQ ID NO: 19577
  ENST00000572135

SEQ ID NO: 19591 - DNA, 2030 bp, Homo sapiens; identical to SEQ ID NO: 19578
  ENST00000574743

SEQ ID NO: 19592 - DNA, 915 bp, Homo sapiens; identical to SEQ ID NO: 19579
  ENST00000572801

SEQ ID NO: 19593 - DNA, 556 bp, Homo sapiens; identical to SEQ ID NO: 19580
  ENST00000574274

SEQ ID NO: 19594 - DNA, 567 bp, Homo sapiens; identical to SEQ ID NO: 19581
  ENST00000576721

SEQ ID NO: 19595 - DNA, 623 bp, Homo sapiens; identical to SEQ ID NO: 19582
  ENST00000571376

SEQ ID NO: 19596 - DNA, 489 bp, Homo sapiens; identical to SEQ ID NO: 19583
  ENST00000575944

SEQ ID NO: 19597 - DNA, 1796 bp, Homo sapiens
  ENST00000625097
aggttacttacgtgttcagaggcaccagctaaggagcaaaagtcaactttgaattctgtgttttgactactgcacagctctatttgcctcattttttatttttaaagcagcaaatcttagaataggagtttaaatccatcacttggagaaaagaaagactaaatgttttttgtttttgttttggagacacgatcttgctttgtcacccaggctggagtgcagtggcacaatctcggctcactgcagcctcgatctcctggactcaagcgatcctctcatctcagcctcctgagtagctgacactacaggcatgtgccaccatgccaagcttattttattttatttttttgatagacactggggtttcgctatgttgcctgggctggttttgaattcctggcctcaagcgatccacccgtctctgccttccaaaatgctgtgattacaggcgtgaaccactgtgcatggccaaaagagtaaacttgaaatctgaggcgaatgacttgattgtgacatcaggtgacctagtaatcagctgtgtattctagctggtgcctctaccagcttcccatgtgaccttgaacatgtcattgaatgctcgctaggcctctgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 19598 - DNA, 2619 bp, Homo sapiens
  ENST00000395123
gagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 19599 - DNA, 2617 bp, Homo sapiens
  ENST00000395124
gcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 19600 - DNA, 2595 bp, Homo sapiens
  ENST00000352187
gctctgggagtgtgaaactgggagagacggttaagctggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 19601 - DNA, 2207 bp, Homo sapiens
  ENST00000529554
agtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttca

SEQ ID NO: 19602 - DNA, 862 bp, Homo sapiens
  ENST00000525205
gcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacagtttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttag

SEQ ID NO: 19603 - DNA, 1879 bp, Homo sapiens
  ENST00000533524
gcgaatgcgaacctggcccgtgcggaaagggcgcggagagccccggcgcggagcaggcgggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcag

SEQ ID NO: 19604 - DNA, 1434 bp, Homo sapiens
  ENST00000530005
tttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtg

SEQ ID NO: 19605 - DNA, 1260 bp, Homo sapiens
  ENST00000528098
attccccacatttgctgccagcggccatgatcatcctgcctcttaatgcacctcacaaataactctagtctacctttccctttcccgcaggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagatcaggaaggtattactgcaagaagtgtcattgaccaggctgtgagagacagatcggatttcaatagagaagaacacagagggtcatccaaggtggtagggccagcatgacaaagcagggaggtggggatgtgtgagtccgaggcaggtgcagagcacgccgggtgagttctgggagccaaggg

SEQ ID NO: 19606 - DNA, 541 bp, Homo sapiens
  ENST00000529113
ttgatctgggaagtgcctgggagggaggcaccagctcctgaggggtaattaggggcagccacatttcaactcagcttaagggacaagtttgcgaccgacaagctgtctgaggtggaggggagcccagcctgtgtgctcatttggcaggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttcttta

SEQ ID NO: 19607 - DNA, 801 bp, Homo sapiens
  ENST00000525474
acattttccctaggtgggcctgagcgagtaacagcattcaactaacttggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcc

SEQ ID NO: 19608 - DNA, 653 bp, Homo sapiens
  ENST00000529112
gggacggtattcagaattcgagcgcaggagctccgcttctccacctgctcccggggagctattgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattggg

SEQ ID NO: 19609 - DNA, 554 bp, Homo sapiens
  ENST00000526125
gcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgatttttctacaccaccgccacactcatcatagccttcacctctgcaggctcagccgtgctgctct

SEQ ID NO: 19610 - DNA, 389 bp, Homo sapiens
  ENST00000530232
gcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggtgcagtggctcactcctgtaatcccagcactttgggaggc

SEQ ID NO: 19611 - DNA, 648 bp, Homo sapiens
  ENST00000528187
gcggaaagggcgcggagagccccggcgcggagcaggcgggggacggtattcagaattcgagcgcaggagctccgcttctccacctgctcccggggagctattgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcag

SEQ ID NO: 19612 - DNA, 560 bp, Homo sapiens
  ENST00000529494
gaatgcgaacctggcccgtgcggaaagggcgcggagagccccggcgcggagcaggcgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctg

SEQ ID NO: 19613 - DNA, 589 bp, Homo sapiens
  ENST00000533245
gcgaatgcgaacctggcccgtgcggaaagggcgcggagagccccggcgcggagcaggcggcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccac

SEQ ID NO: 19614 - DNA, 581 bp, Homo sapiens
  ENST00000533235
aaatagagtgtgtgtgtccctatgccctcatgtgctgtctgtgtgtcctctgggtgctgggtgtgacattttccctaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttcta

SEQ ID NO: 19615 - DNA, 539 bp, Homo sapiens
  ENST00000524863
gcgaacctggcccgtgcggaaagggcgcggagagccccggcgcggagcaggcgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcct

SEQ ID NO: 19616 - DNA, 587 bp, Homo sapiens
  ENST00000532795
atgtgctgtctgtgtgtcctctgggtgctgggtgtgacattttccctaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccac

SEQ ID NO: 19617 - DNA, 571 bp, Homo sapiens
  ENST00000533051
gcgaacctggcccgtgcggaaagggcgcggagagccccggcgcggagcaggcgggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtcct

SEQ ID NO: 19618 - DNA, 494 bp, Homo sapiens
  ENST00000529896
taggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagagg

SEQ ID NO: 19619 - DNA, 562 bp, Homo sapiens
  ENST00000526621
gcaaaatgcacaaatagagtgtgtgtgtccctatgccctcatgtgctgtctgtgtgtcctctgggtgctgggtgtgacattttccctaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggct

SEQ ID NO: 19620 - DNA, 573 bp, Homo sapiens
  ENST00000530316
gcgaatgcgaacctggcccgtgcggaaagggcgcggagagccccggcgcggagcaggcggtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaagg

SEQ ID NO: 19621 - DNA, 397 bp, Homo sapiens
  ENST00000529748
gggaggctgaaaggcagcgaggagggagggaaagacaccgctggggttctagggggttctagagggagaagtttcaagagggagaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggc

SEQ ID NO: 19622 - DNA, 506 bp, Homo sapiens
  ENST00000532278
tttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccagtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggc

SEQ ID NO: 19623 - DNA, 3896 bp, Homo sapiens
  ENST00000370859
acagtagtgaatcgtagcatgttagagttagaaggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttcttggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatactaagatcatttgttttgtaattcgtttttaaagagtggcttggatgttttgaaaatactactgaatatgttaatattcttttaaatcttagattgaaaaatgatacattacttaaattgatagctcctaatatatttttaaaattacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgccaatcatccagcctttactacttagccctctgacaaagtgccttactggctatttaatattacccagcttttatgggcaagtttacaaacattgttttttaaaaaattaaaacctgcaatgtttcgtgattaaaacaagtcttattgcatttgtttcactcttagctcactgattggaaaacatttgtcattttgctctgtttgatatcctcactattatggaatacattgtgcagctaaacaatttcccttgcgcctagtggacattcatgaatgtgtactacacgcaagaagaaacaaaccccgaaagaacacttgttggatttctttgtttttttttttactaaaagagaagttttaaaatgaaatgttttctatagtagatctttgaaaatacaataggtataatactgcatttctcagtgttttacaaagatcagaaagagaaacttctaggaattgcaaagggaaactttactcctcgaaagggtgctcacagatgtcatgtactgaatagctcccttttaaatgatcatttattttcatcaaagcctgttctatatatgccacttcattttctaacttttggtatgaaaaaatcagtttacttacagtatgttaattgtattgtactactataaacaggaacataatttccaattcagttttaaataattttaccagtactactaacttttaaggaaattaattcagttggttactcagtgtttgttacagaaagagtccagaaaagtattcaccctaagagaatgtcaatcatataatgataatttgtgaaagctttgagaatcaatcatcagtaagttactatcagtttataaaatattatcacatttgtttaaatgtgactttagatacttttatgccaaaaataaactcacatgagcacatgacagtctgagctctataatcagtgtgcttctgctgtgcagaaatgttagaaacgtattgtctaaatatctttgataattaaaatgtttaatatttaatgaaatttgttgttacttgttttaaatcttttttcttttaataaagatttaaataagaaat

SEQ ID NO: 19624 - DNA, 4406 bp, Homo sapiens
  ENST00000370855
aggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgaagatctggaaagaaatgatggatctacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattctaagaagtcagcacctggtactacctgaggtgtcaggtatttgatgacattagctgctgtctactttatagacagtggtcccagctaaagatcaaaatgttaatgtcaaacgttttttaaaatctgtagccgagagtgttttaataacttttataactcagcgtgctgtttccattgcagcactttaatagcctttctttttataagtgtatatttgtaaaggatattcaggcaatttttgaaaacactataaatgtgtaattaattagccataaaatattgatttatagttaaccagcatatggtactaaatttgtaaatatggtgctatggttatatttatactgttcaagctggtggacaactctctaaactgtgattaaacttgtattaatggttccctaggaagtatatttcagtgagtcatgtccataacaaacatagatgttaatgttatataggttctacggagagcattactgggtaaaaaatactatggaaccttcagagcccattctgttttagtgaaatcatgtttatattgaagtcgaatctgagttctggagtgtcatttccaacaacatgaacctctgtccatggtgaaaatattctgaacaaaactgaaattgttacataactcatgccttttgtctttaacccaaatttcttattcccactatatagaaaatcaatatgaatttgtttcagaagagtgattatatcttttcatgagtatacctgtatttctagattaaagagattgtgtggctttgttctacagaaggtttgattttgtctcacctttcagtgaggaaagagaaaagaaagacacttcagattttaccctaaggaaatatactgttggcgctccatcatctaatacctttatgaggggcatactgtgggttaggaactctctctctgcagggcttaggaggaaagttgttgccacctgccaccgctggccgcctgaggtttctgatagtcatgtgtaagttttgaatggcagaacaaagcatgaatcagacacacatcttgcctagccatcccctgtgtgcaaatgtgtatgatgtggttaaccatgtaaaaatgcaccccaaaaggagcattgaatcaatttgtattttcttggcttttaccttaaacttgtatataaggattatttatatattgacagaaaggaacatgttgatctgaatatcactcatatatccaagaaaagagtcagaaatgtattgttgtgttatagattgatctaaatacgtattaattatcttcaagtgtagacacctagatttaaactgactctgtggcagattaattaatagcaataagccaatgaatagggaagatttttaatatataatgactaccagcttgttcttggcttacattcttgagattattgtattcaaaagtgtcagttggcttcacattttggcaaagagccttctgcattcttattctccttgaagcataatgcagataatgacaacttatctttctagattagtcttttattattcaacaagacaaaggccacaacaaaggactagtagaatagtgacctctacctgagaatttgttataactatagatgtttgtgctctgcccaagagattctgatatactgtgatttgatgtgagccacgatgtgaattattataaagttctctagttgattctgatacacataaaagttgaaaaattggccatgtgtggtgtctcacgcctgtaatcccagcactttgggagtccaagatggacagatcactggagcctaggagttccagaccagtctaggcaacatggtgaaaccccatctatctttataaaaaatataaaagttagccaagtgtggtggtgcacacctgtagtctcagctacttgggaggctgaaatgtgagggtcacttgagcccaagagatcgaggctgcagtgagccatgatcacaccactgcactccagcctgggtgacagagcaaaaccctgtttaaaaaaaaaaagttgaaaaaatcacttg

SEQ ID NO: 19625 - DNA, 721 bp, Homo sapiens
  ENST00000469525
gttagagttagaaggttcagtgttgatggagttattgaagaaatgatggagtaagagactcttttctaagcaactcaagtttgcagtgattcaggcctacttctgaagagacagccttttatctcaatgaatgacacagggtctgagattactgacatgcttcctgctatacccggcactgattccaaatgggactgggtctgcagaaaaaccagcagatactccctctgaggaagaggactttggtgatccaaggacatatgacccagatttcaaggggcctgttgccaacagactaaactgggaactccgtgagagaaagcatctcatctgtgtggttcaccaacgtttcatagcatctgccacagtatccggcacaaaataggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccg

SEQ ID NO: 19626 - DNA, 2784 bp, Homo sapiens
  ENST00000471889
tttatacatgaagacacgaaaatgtatttatttcttttaaaatcagaagaaaacggtgagaactgtgaggccggggggacgttttcctccgggatcctggcagatcctgcagaccgcgccgtcgtgcgcgaagcaccgggacgggcctcccgcgggaagggcccaggaggacaccgggctcccctcccgcccgcggggccccagacgcggcgccgctttaaggctccgggccccgcgcggatgcggaggctgcggccgtgacgtcagcgccccgccccgggtgatgctgcagcagccgggaccgcggccgggcaggcagcagcccagcggggacagggatgcctgccgtctccacccacagggacgcccaccagccctccccacgatgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagcc

SEQ ID NO: 19627 - DNA, 1747 bp, Homo sapiens
  ENST00000497660
aagaacggggccaccgcgtttggggcttctcctcccgcagaagggaactcaaaccctgtctctttccccaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcg

SEQ ID NO: 19628 - DNA, 694 bp, Homo sapiens
  ENST00000481265
cgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggtctctttctgctgtcgagtggttgaacattt

SEQ ID NO: 19629 - DNA, 2401 bp, Homo sapiens
  ENST00000289877
atgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagccta

SEQ ID NO: 19630 - DNA, 2448 bp, Homo sapiens
  ENST00000460934
atctctgcttgcggtttcaggaaggcctctggctgctctaggagtctgatcagagtcgttgccccagtttgacagaaggaaaggcggagcttattcaaagtctagagggagtggaggagttaaggctggatttcagatctgcctggttccagccgcagtgtgccctctgctcccccaacgactttccaaataatctcaccagcgccttccagctcaggcgtcctagaagcgtcttgaagcctatggccagctgtctttgtgttccctctcacccgcctgtcctcacagctgagactcccaggaaaccttcagactaccttcctctgccttcagcaaggggcgttgcccacattctctgagggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgttta

SEQ ID NO: 19631 - DNA, 3341 bp, Homo sapiens
  ENST00000367145
aaggaagggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgttta

SEQ ID NO: 19632 - DNA, 5852 bp, Homo sapiens
  ENST00000264485
gcgctcgcggcacagcctccgccgcggccgccttccgtgagcccccgcaccccggcttgctcccgaggggcgcctgggctgggctccactgctgcagtgttagttactagcaggaacatcagagatccccataaatatgcaggagctgcaggaggcaaagtagagtagacgcccgcgctcttacacactcgctcgccgcgcaccacacaggctgtgtagacatccccccgcgccacctttcccctttcctcgcgggccgttcaggttgcagtcctgcctgctccgaagaccctcccgccccagcgcctttgccccgctctcccgcgctcgcctctctccggagcgcgcacccacccaggcggcaaagttgtgactacttgggcgcgggtgactggcgccccgctcgctccgcgcccggcgcagacaacttcccgcggctcggccccgccgcgtcccgggctcgcgcctccagggattccgcggccccccagcctccaaccccggcggcgcgccgggcagcgcttcggtggcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccac

SEQ ID NO: 19633 - DNA, 3771 bp, Homo sapiens
  ENST00000351898
ggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaac

SEQ ID NO: 19634 - DNA, 956 bp, Homo sapiens
  ENST00000639096
tattaagaggctggctggaagctaggctcccactgtgcactagcctacctccctgtcgctctctgcgtgtgggtgggtgtgcatgtgtgtgtgtgtgagggtatacattttatgcagtgggtgtttaaagagctaagcactgaagctggatttccacaaacgatcatcacgagcactccagacacaccaaacttcctctcttggtattttttttttttttttgctttcatcctttttaaaaagaattttaaaaccctaaaggggagagcccccaacatcctgcctacaggattgggattattttctcttacctgtctatgtgggtgccctctcaaggttagaactgaagctatgtgggaccggcatattctcgagcaccagatgagaggagctgcgtgaagcagtagcagacaccagaagaagagtgactctgccctgctaacatgaacaacagcttgcaggttaacctgcccagaagctgggctgctccaagtggctcgctccaggagaagtctgagcattctttttttcttttttattactataggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaa

SEQ ID NO: 19635 - DNA, 468 bp, Homo sapiens
  ENST00000638464
tgtgcactagcctacctccctgtcgctctctgcgtgtgggtgggtgtgcatgtgtgtgtgtgtgagggtatacattttatgcagtgggtgtttaaagagctaagcactgaagctggatttccacaaacgatcatcacgagcactccagacacaccaaacttcctctcttggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggag

SEQ ID NO: 19636 - DNA, 2169 bp, Homo sapiens
  ENST00000514331
aggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccaggtgagggcattacgctttgtgtttatgctcgctttgtatttggaggaaggtgtaggctccatgcttgcaaattttcaacatgctgtcatggtcctcaggaattagtcttgtttttttctctgaaaaactctgctactgaatttgatgtctcattgcctgaggtattttagctgtatgattcaaccaggaaggagaccaggagctctggaatgtgaacataaccaactcaatattttgaaattaactcaaactgtgggatttgcaaggaattcatgtgtacattattcttgattttataagtggggaaacctggatacatgtattaacagatataaat

SEQ ID NO: 19637 - DNA, 2316 bp, Homo sapiens
  ENST00000512686
aggaggggaagtgagtggttagacctcagctcatctgagggctaaaggttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccaggtgagggcattacgctttgtgtttatgctcgctttgtatttggaggaaggtgtaggctccatgcttgcaaattttcaacatgctgtcatggtcctcaggaattagtcttgtttttttctctgaaaaactctgctactgaatttgatgtctcattgcctgaggtattttagctgtatgattcaaccaggaaggagaccaggagctctggaatgtgaacataaccaactcaatattttgaaattaactcaaactgtgggatttgcaaggaattcatgtgtacattattcttgattttataagtggggaaacctggatacatgtattaacagatataaatatgtgacaaacc

SEQ ID NO: 19638 - DNA, 7640 bp, Homo sapiens
  ENST00000340595
aggaggggaagtgagtggttagacctcagctcatctgagggctaaaggttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcattta

SEQ ID NO: 19639 - DNA, 7596 bp, Homo sapiens
  ENST00000425175
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgatgagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcattta

SEQ ID NO: 19640 - DNA, 6447 bp, Homo sapiens
  ENST00000419036
gtaatggaagtggtggaagcagagaaaatagtactgttgacttcagcaaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 19641 - DNA, 7757 bp, Homo sapiens
  ENST00000295736
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 19642 - DNA, 7385 bp, Homo sapiens
  ENST00000428386
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 19643 - DNA, 4159 bp, Homo sapiens
  ENST00000454389
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 19644 - DNA, 4120 bp, Homo sapiens
  ENST00000440156
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 19645 - DNA, 3600 bp, Homo sapiens
  ENST00000457377
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 19646 - DNA, 3825 bp, Homo sapiens
  ENST00000438530
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 19647 - DNA, 3667 bp, Homo sapiens
  ENST00000437179
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 19648 - DNA, 4000 bp, Homo sapiens
  ENST00000446700
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 19649 - DNA, 3775 bp, Homo sapiens
  ENST00000455077
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 19650 - DNA, 4061 bp, Homo sapiens
  ENST00000445684
gccggttcgctcagttctagcttcaggttccacgccgcggcctcgctctcctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 19651 - DNA, 735 bp, Homo sapiens
  ENST00000465487
tactcatgagttctaattgtgttcattttatttacagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatat

SEQ ID NO: 19652 - DNA, 3407 bp, Homo sapiens
  ENST00000437266
gctctcctccttcccgctcggtccgccggttcgctcagttctagcttcaggttccacgccgcggcctcgctctcctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatag

SEQ ID NO: 19653 - DNA, 3224 bp, Homo sapiens
  ENST00000428179
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggagtctgcctcctggcactgtagttgtggcacactgggtgtgggactcaagaggcccgctgttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagag

SEQ ID NO: 19654 - DNA, 770 bp, Homo sapiens
  ENST00000475120
aacccaaactttattccattctgttgtttctgatgtattttccactttctagtctccatgcttctcaatgtgggaaaaaaagaagttaaaatctaccacattgtataattgatttagtaaaatgtaagcatgaaattcaggatccttaaaaatgtatcctactctaatttctcagatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtaactgtgatataattttggaattctggtaatattcatatttttggtttttatttccttggtttatttcaaaacagtaatatattttttgaggttaatactccatgccaactggttaataaagaaattattcgtagtgaaaaatgtatattacgtgcctgagctcacagtaggaagatgatggtaccataagagttgctaggttagttgcgaaatgtgtttcttatatttttggaaagaattaaatataaatgtgtttcactgttaacattgtcactagttaaaagctccatttgtacgttgtagtgacaattttatcaataaaag

SEQ ID NO: 19655 - DNA, 574 bp, Homo sapiens
  ENST00000491211
gtttatgataattaaaagtatattccctaagtatttttaatgataatcagactcaggtcttccatcttttgtggttcacaccaactcacgttttatttctttttgcaaaaggccacaatttttgtaaattctaattgtattattttaaatattaaaatgtatagctttggtattgcttaaaatgttgttctagttttgctggtatgttactaacaccgggcacttattttttttaaccttgcacatttgcttttataatattcataaatcatcactttcagaatgtgagcagaatcaggttgcaaagtgaattttctccttactaatttggaatttgtctttaaacataggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactg

SEQ ID NO: 19656 - DNA, 1572 bp, Homo sapiens
  ENST00000428005
gctctcctccttcccgctcggtccgccggttcgctcagttctagcttcaggttccacgccgcggcctcgctctcctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggtaattctatcattaactgaaaattctcataattattcttactgaggaaataagtagtaatttgtggctaatattattaacattgatgatagtaattttttagtagactggtgcttacaaacctgcatgtgatgtctgtgatatgttaatttaaggtaaaaactgtgagaagggttacagttaacctgtgagtacttgaataactttacaccattactagtgttagaaattctgaaaaagaatatgtgaataatacgatatttccatccatacctacccatagatatcgtgaaacgtcagtactttttgaactacagtcatttgttctggagctaccaccactagaacgttaattctgggagtgatgttacagcactaatgattcagtctttcctg

SEQ ID NO: 19657 - DNA, 7970 bp, Homo sapiens
  ENST00000425128
gctctcctccttcccgctcggtccgccggttcgctcagttctagcttcaggttccacgccgcggcctcgctctcctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttctcgtgaggattacagtgaggactagggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatagcagggatttgaactcaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccaggcaatgttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagt

SEQ ID NO: 19658 - DNA, 2745 bp, Homo sapiens
  ENST00000347898
ggttgctgttcctgttgctgccactgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactgggtgagtgaagcaggatggtgccttgggctccagcgtctccccaacccctccatgccatgggtccccacgcaggtgaggaccctggtggaggacggtgtgggcagagcgtgggacatgtcaccttccccacctgctcagagttcaagggtcctgggctgggccccgttctctcttctgccctggggagatcattcacgcttcctttaatccccgctgcagctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaagg

SEQ ID NO: 19659 - DNA, 2703 bp, Homo sapiens
  ENST00000488922
actgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatgggtgggatctccctctgttgctcagggtactagaacgcagtggtggcaatcatagctcactccggcctcgacttcttgggctcaagtgatcctctcacctcggctgccagacacagaggaggtactatctacgaggaacaggctctcaccagacaccaaacctctcggtgccttgatattgaacttccaagtctccagaatttccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaa

SEQ ID NO: 19660 - DNA, 577 bp, Homo sapiens
  ENST00000564125
agctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggtaagacaccccctgcccccaaacaggtagccactctccaaactgggaagttggtctggggacaggtgctggcagaaggactccagctgtcacctgtggggcaggggaagctcagccctctctgcagagaaagcttgtcatacaccaggacaatggagtgtgtttgtggggtgggcatggtggtatgaagccagcagccggcagccagcagcaccgtacgtgggtcccagctcttccacttaaccaaggtcagggacattgagccaaacattttgcctcaccgagtctcaggttccttatctgtcaaatgggaat

SEQ ID NO: 19661 - DNA, 2214 bp, Homo sapiens
  ENST00000565769
ggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttacca

SEQ ID NO: 19662 - DNA, 591 bp, Homo sapiens
  ENST00000569520
acagtggaagactgggtgagtgaagcaggatggtgccttgggctccagcgtctccccaacccctccatgccatgggtccccacgcagctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggt

SEQ ID NO: 19663 - DNA, 2139 bp, Homo sapiens
  ENST00000568579
gctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccaggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttacc

SEQ ID NO: 19664 - DNA, 2246 bp, Homo sapiens
  ENST00000567758
gctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccac

SEQ ID NO: 19665 - DNA, 1919 bp, Homo sapiens
  ENST00000569071
gctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaag

SEQ ID NO: 19666 - DNA, 475 bp, Homo sapiens
  ENST00000565586
ctgggatgcagtggattaacaagggatgacgtatgactcttctgtgtttgtcagcatctaggctaggccctgatcccagggaacctgtgctgcaaatgtccactcattcattcattcgttcatttgttcatccatcaacctcctttcttcacaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgaca

SEQ ID NO: 19667 - DNA, 2294 bp, Homo sapiens
  ENST00000545376
actgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccaggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaagg

SEQ ID NO: 19668 - DNA, 2069 bp, Homo sapiens
  ENST00000449109
actgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaagg

SEQ ID NO: 19669 - DNA, 2399 bp, Homo sapiens
  ENST00000424767
actgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaagg

SEQ ID NO: 19670 - DNA, 2030 bp, Homo sapiens
  ENST00000266086
ctgcctgcagccatggccagtacggttagccccagcaccatagctgagaccccagagccacctccattgtctgaccacatccgaaatgctgctgacatctcagtcattgtcatctattttctggtggtgatggctgttgggctgtgggcgatgctgaagaccaaccgaggtactataggaggcttcttcctcgctggtcgtgatatggcctggtggccgatgggcgcctctctctttgccagtaacatcggcagcaaccactatgtggggctggctgggacaggagcagcttcaggagtcgccaccgtaacatttgaatggacttcctcagtaatgttgctgattcttgggtggatctttgtccctatctacatcaagtcgggggtgatgaccatgccggaatatctcaagaagcggtttggtggggagcgactccaggtctacctctccatcctctccctcttcatctgtgtggttttgttaatttctgcagacatatttgctggagccatattcatcaagctggccttgggattggacctttacctggcaatcttcatcctcttggctatgactgctgtttacaccaccactgggggcttggcctcggtgatttacacagacaccctccagaccatcatcatgctgattggctcttttattctcatggggtttgcatttaacgaagttggaggttatgagagctttaccgagaagtacgtgaatgccaccccatccgtagtcgagggggacaacttgacaatcagtgccagttgctacacacctcgggcggactccttccacatcttccgagatgctgtgactggggacattccatggccaggaattatatttggaatgcccattacagctttgtggtactggtgcacaaatcaggtcattgtgcagcgctgcctgtgtggcaaggacatgtctcacgtgaaggccgcttgcattatgtgtgcttacctgaagctgctgcccatgttcctcatggtgatgccggggatgatcagccgcatcctgtacacagatatggtagcatgtgtggtaccttctgaatgcgtgaaacactgtggcgttgatgttggctgcaccaactacgcataccccacgatggtgctggaactgatgccccaaggactgcgaggcctgatgctttcggtcatgctggcctctctcatgagctccctgacctccatcttcaacagcgccagcaccctcttcaccattgacctctacaccaagatgcggaagcaagcgtcggagaaagagctcctgatagctggacggatatttgttcttctattaactgttgtgagcattgtgtgggtcccactggtacaagtttctcaaaatggacaactaatccattacacagaatcaatttctagctaccttgggcctccaattgcagctgtctttgtgcttgccatcttctgtaaaagagtcaatgaacagggagcattctggggtctaatggttggacttgcaatgggcctcattcgtatgataacagagtttgcttatggaacagggagttgcttggctcccagtaactgtcccaagattatctgtggagtgcactatctgtacttttccatcgttctcttttttgggtccatgctggtcaccctgggaatttccctcttaacaaaacccattcctgatgtacatctgtaccgcctgtgctgggttcttcggaacagtacagaggagcgaatcgatatagatgcagaagagaaaagtcaggaagaaacagatgatggtgttgaagaagattatcctgagaaatcacgtggatgcctcaagaaagcttatgacttgttctgcggtttgcagaagggacccaagctaaccaaggaggaggaggaagccttgagcaagaagctcacagacacgtctgagaggccctcgtggaggacaatagtgaacatcaacgccatcctcctcctggctgtggtggtctttattcacggctactatgcctgaactctatctgagccattagaataatgaataattcttaa

SEQ ID NO: 19671 - DNA, 2032 bp, Homo sapiens
  ENST00000409059
cgattcccacctcgccctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccagacttaatgaagtagccagctgcagaagaatctggatcattagataaaaatggctttccatgtggaaggactgatagctatcatcgtgttctaccttctaattttgctggttggaatatgggctgcctggagaaccaaaaacagtggcagcgcagaagagcgcagcgaagccatcatagttggtggccgagatattggtttattggttggtggatttaccatgacagctacctgggtcggaggagggtatatcaatggcacagctgaagcagtttatgtaccaggttatggcctagcttgggctcaggcaccaattggatattctcttagtctgattttaggtggcctgttctttgcaaaacctatgcgttcaaaggggtatgtgaccatgttagacccgtttcagcaaatctatggaaaacgcatgggcggactcctgtttattcctgcactgatgggagaaatgttctgggctgcagcaattttctctgctttgggagccaccatcagcgtgatcatcgatgtggatatgcacatttctgtcatcatctctgcactcattgccactctgtacacactggtgggagggctctattctgtggcctacactgatgtcgttcagctcttttgcatttttgtagggctgtggatcagcgtcccctttgcattgtcacatcctgcagtcgcagacatcgggttcactgctgtgcatgccaaataccaaaagccgtggctgggaactgttgactcatctgaagtctactcttggcttgatagttttctgttgttgatgctgggtggaatcccatggcaagcatactttcagagggttctctcttcttcctcagccacctatgctcaagtgctgtccttcctggcagctttcgggtgcctggtgatggccatcccagccatactcattggggccattggagcatcaacagactggaaccagactgcatatgggcttccagatcccaagactacagaagaggcagacatgattttaccaattgttctgcagtatctctgccctgtgtatatttctttctttggtcttggtgcagtttctgctgctgttatgtcatcagcagattcttccatcttgtcagcaagttccatgtttgcacggaacatctaccagctttccttcagacaaaatgcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtga

SEQ ID NO: 19672 - DNA, 5152 bp, Homo sapiens
  ENST00000264047
ctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccagaagacttaatgaagtagccagctgcagaagaatctggatcattagataaaaatggctttccatgtggaaggactgatagctatcatcgtgttctaccttctaattttgctggttggaatatgggctgcctggagaaccaaaaacagtggcagcgcagaagagcgcagcgaagccatcatagttggtggccgagatattggtttattggttggtggatttaccatgacagctacctgggtcggaggagggtatatcaatggcacagctgaagcagtttatgtaccaggttatggcctagcttgggctcaggcaccaattggatattctcttagtctgattttaggtggcctgttctttgcaaaacctatgcgttcaaaggggtatgtgaccatgttagacccgtttcagcaaatctatggaaaacgcatgggcggactcctgtttattcctgcactgatgggagaaatgttctgggctgcagcaattttctctgctttgggagccaccatcagcgtgatcatcgatgtggatatgcacatttctgtcatcatctctgcactcattgccactctgtacacactggtgggagggctctattctgtggcctacactgatgtcgttcagctcttttgcatttttgtagggctgtggatcagcgtcccctttgcattgtcacatcctgcagtcgcagacatcgggttcactgctgtgcatgccaaataccaaaagccgtggctgggaactgttgactcatctgaagtctactcttggcttgatagttttctgttgttgatgctgggtggaatcccatggcaagcatactttcagagggttctctcttcttcctcagccacctatgctcaagtgctgtccttcctggcagctttcgggtgcctggtgatggccatcccagccatactcattggggccattggagcatcaacagactggaaccagactgcatatgggcttccagatcccaagactacagaagaggcagacatgattttaccaattgttctgcagtatctctgccctgtgtatatttctttctttggtcttggtgcagtttctgctgctgttatgtcatcagcagattcttccatcttgtcagcaagttccatgtttgcacggaacatctaccagctttccttcagacaaaatgcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtgaccccatctaaataaaatactgcttttgcaaacagaacactgtaatagggtagttctggagagatggtatgcagcatacaaaaatatattaaaaatataaacaatgttcaggagagtaaaaattcatataaagtgcaattgcacaaatacaagccaagctagaaggaagcacctatgaaagcaacaactttgtttctcatccatagtagtattgattttgatgctagatagttttgctaggtataaaaaataagtaaagttccacttagagaacaaagggccaaatagagtttttatatttgttatgataaaaggaagtagatgtgaaaaagcctaagaaaaaggaaattggacagttttgatacaaactttgtttgctaatgcactgatgagtctagtttcattatagcacgaagctatgagaataacttcagtcactcccttgaatggtgcaatgaattaaccagctgatttttcttagtgtgatgattaaccccttctttcatgttctgagctataacatttgctgaatatgcaatttgttattcttttattaatggcatgtaatattctgagcacgggcaaagaaaacacacaaaagattatgtattggcatttatttatgtgcaaggtgataggaaaactgaatccatctttgtagaagagcactgggctaatttgtatgtttccatagctactatatgcataaacaacagtacctgaaggattattaagcaaccttaaagcaataagttcattaaacagaaggtaataggaagaacagtacatttttgtctttatctcaagtatataaagttttgccccatgataaaataagtaacatataaattaatacataagttaatattggaagtgaaattaggccttatgtaaggagaggtagctacacagcatctgttacggttaatgagaggcacactgctaaatttacgtatatttcattgaatactttatgggaagcctccacaacacctcctgatagtagtaaaattagaaaaaaacaaactctactaatttttagatattcattaataggaaagatttaatgttacagcatctactctttggcactttttcacataagccagccttagagactagacaaataactactgcaaaaagtacatagtgaattttaaaatgtagaagaaagcaaaaaataaaataagtcctaaagtgaagaagccatcaattttaacatttgatgtctagataacattcatgagattggtcattaaatactattttgctccttttctggtgttacacatacacactcatacgtgtgtgtgtgtgtatgtgtgtgtgtgtatgtgtaatgatttgtgtccatttcaagtgttttcacaccagtcacacattatagaaattactggagccatgtctacaaaagcaaagtgaagtgatgagctgaaaagtgatcagggaatctgatcccataaagaaagtgagtctgaattgttgaaactaaagcacttcttttccaaaaatacttctgcaactcatgaacaaaatgaagttaacttagtgtttagcattaaaaataaaagttgtaccttgaccctagaattccttttataagatttaattgtaattgtctcaaagcatcaaataatacatctttatcattaaacatgaatttaatgtctaggataatttttaaaagaggaaattaaataattttacatgtctcatattttcagtgctttctcaaaatttgatggtgaatattacattgcattcaaaatcttcactgaatatcatatgtatctaaatgaaaagagaattacttatattcatctattttctcagaatctattcagtaccctatggagtacatggaagaagtatatttttggaaccagtaagtatgggagtccacgattctcaggtattgattgaaaaaagagaaaggggcaagaaattcattaaagaaaaaccacagatactgaaacatttgacacataaaagtaattaattgctggagactacaattcctggcaaacaccattattccagatgcaccatgctacccagcatgctacctgaatggcggtttttatccatcctgtcaccctgagcatctgtctcaacctgctgaggcacagacttccaccatgtgcatcaggaaacacctcactcatactgtcatataatgcaacagggaggcatagtctctctacaggtctctctctttacgttgtaccattctgttgggcaacaattgtcccaacaaccacacttaaatccagtggggaaaaaaaggttaacagtaaaaatttcttccacgtaattcaatttctcacaatagacagaaacagggggaaaatgtttgccctgttcaaagtactaaaactagataacttaaataatttaagccaataaataatattatattgtatttaacccattattcctcacctaccctcaaagtaggtatacaaaagactagtttgttattaatccacaaatatgctaaatgttagcaagatgatttttaagtacaaaaaagtttaagattgcaaggaaggaaacaatggtcacaaggtctttacttatgcacatttgtgcataaatttccacccaatttccaagacagttgtatcacaaagctgtgaaatgtgcaagagtatactttgtacccatcatgtgctctgttttgacataatgagtaatgcagacatttacatgttcttccagcttcaatcagtagacctgattttcaaaatctgccctcagatgaaaataaaataaacgaaacatttagacaatggctatattaatctgggaaggcaacacctgtggataaaacattagaagaaaacatatattttattttcatacttttgatatgattgtaacatatttcttgagtaatttaaatgctttgttttcccacacatattcaaatcagcaagcttgtagctggactgcaatatcaacaacaagttgtttcaaacagcatcaaaatacaacttcattgctacacttacaagtaatgaattttatgtgactatgaaacgaatataagcttaaaataagtgaatctaataaaatggctattcctctttttacttggaaataataaattaacattatattttaaacataaa

SEQ ID NO: 19673 - DNA, 4178 bp, Homo sapiens
  ENST00000536262
attaacctatcaaataaggcagtctaaaaactccaggcgtccctttccgtaaggacccggactgttgaactggaaagctaaaattcaaggcgtgacaattgccctttgtcccacattcctccaccggtcgcctgcttatttaaatggtgcgtcccctcgggtaccacttgaacaaaacctgcccagagcgctccctgtgtagattcgctggaagcagctggaggctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgttttggggccatttttagcatctttgccttcacctacttctttgtggtggtcatcagcgcggaggtcttcctcccggtgttctacaaactgggaattaccagcacctacgagtatttagaacttcgatttaacaaatgtgttcgtctctgtggaacagtcctcttcattgttcaaacaattctgtatactggaattgttatttatgcccctgccctggctttgaatcaagtcacaggatttgatctgtggggcgcggtagtggcaacgggggtggtctgcacattctactgcacactgggtggtcttaaagcagttatctggacagatgtttttcaagttgggatcatggtggctggatttgcatccgtgattatacaggctgtggtgatgcaaggtggaatcagcactattttaaatgatgcctatgatggtggaagattaaatttctggaattttaatcctaaccctttgcaaagacacaccttctggacaattattataggagggaccttcacatggaccagcatctacggtgtcaaccaatcccaggtgcagagatatatttcttgtaaaagcagattccaggcaaaactgtctctctacatcaatcttgtgggactctgggcaatcctcacatgctcagtgttttgtgggctcgccctatattccaggtaccatgactgtgatccttggacagccaagaaagtgtctgcaccagaccagctcatgccttatttggtactggacattctgcaagattatccaggacttcctggactttttgtggcctgtgcttacagtgggacattaagcacagtgtcctccagtattaatgccttagcagcagtaactgtggaagatctaatcaaaccttacttcagatcgctctcagaaaggtctctgtcttggatttcccaaggaatgagtgtggtgtatggagccctgtgtattggaatggctgcgctggcgtcacttatgggagctttgttgcaggcagcactcagcgtatttggtatggttggtggaccacttatgggcctgttcgctttgggcattttggttccctttgccaactcaattggagcacttgttggtctgatggctggatttgccatttctctatgggttggaattggagctcaaatatatcctccacttcctgagagaacattgccattgcaccttgatatccaaggctgtaacagcacctacaatgagacaaatttgatgacaaccacagaaatgccatttactactagtgtttttcaaatatacaatgttcaaaggactccactgatggataactggtattctttatcatatctgtacttcagcactgttggaactttggtaacattattagtggggatacttgtcagtttatcaacaggaggaagaaaacagaacttagaccccagatacatactaaccaaagaggactttttatccaattttgatatttttaagaaaaagaagcatgttttgagctataaatcacatccagtggaagatggtggaactgataatcctgctttcaaccacattgaattgaactcagatcagagtggcaagagcaatgggactcgtttgtgaagctgctctgatactagatatccttaaatgatgtttcaattttatatgttttctaagataattggatcaggttttctttgtgtgtgtgtgtgtgttgtatcatgagtgtttgggggataagtttttgttaaaacaaagtctggactatcttcatttactacatcattaattgatgttactctggagtttagaattctggcattgacatttccctctctttcctttatttcgatgaagctataattgtgaaaattgtaactacatagatgctgaaaggctaatacacacatatgcacatgtatttgattgtcaaaggtatattcttaaatttgggtattattgaaaatattttccatgccttggtgctagcatataagtttggaagtttgccaacatcacaattcatcttgaaaagagcttttttccctcctaccacatacaccattcttagggagcaatgaggtaacaggtctgtgttgtctagatctttgctttttatccccctatcagtccagggcatatactaacctgcaaactgattctgaatcaggaaggtggtaatcaataagtattctggctgggaaagaccgtgggcccaatgatcaaagtcttcttggtgctgttcattaattcttgtgccttttggcttgttttctagagtttctgggctttggctgctgatactgcctttcttagactgtaatttttatctgcatgcccagtttctgacctatcaacttgggttttattgtgcactctaactgagcttgtcttcataattttctgtttattgccctgggcttggatatgtctcaagacactcatgtgaatcatgccaccccaaatcctggcttatcaagtcccagactataaattatgaactcccattagcttggtactaacatatacttgatgtaggtatttatggacttgatgatccaagaatattatattcttcaaaatggttaagctccatggagttagatgactacacttaatgctattaagttgaacttttgaatgtcaactaatttgcaatcaattaaagatacatatgcctagaaattttgaaatttcggtatatttatccagttaaagggctaaattatataagcaaacactactttttttaaaacgtctggactcaaaaaatgctttgttccatgttttaaaatttttaagtagcagtctcaaagttgcttagctgtttattttgctatgttcctagctaagagtttggttataggagttcatcaataacttattttttgtacagttcccacattagatactgtttaaaagttcttttttaaactcaattttttttagaaacataagagaaatatttagatacatacaaatgtttttatgattaaataattttatgcttattttctgatacgtgttatttaggtaatcatgccctgtacatttagaggttgctaactgacaatgttaagaaatttaaaaaaaaaaaaaagcctgggcatgatggctcatgcttgtaatctgaacatttgggaggctgaggcaggaagatcgcttgaggtccagagtttaagtccagcctggaaacatagttagacctcatctctacaaaaataaaaaataaaaataaaaaaaacttagctaggcatgttgccacatacttgtagtcccagttattagggaagctgaggtgggaggatagcttaagcccaggatttcaaggctgcattgagctatgattacaccactgcactccagcctgggtaacagagtgaaatcttgtctctgggaaaaaaaa

SEQ ID NO: 19674 - DNA, 3983 bp, Homo sapiens
  ENST00000572861
gtgtagattcgctggaagcagctggaggctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgttttggggccatttttagcatctttgccttcacctacttctttgtggtggtcatcagcgcggaggtcttcctcccggtgttctacaaactgggaattaccagcacctacgagtatttagaacttcgatttaacaaatgtgttcgtctctgtggaacagtcctcttcattgttcaaacaattctgtatactggaattgttatttatgcccctgccctggctttgaatcaagtcacaggatttgatctgtggggcgcggtagtggcaacgggggtggtctgcacattctactgcacactgggtggtcttaaagcagttatctggacagatgtttttcaagttgggatcatggtggctggatttgcatccgtgattatacaggctgtggtgatgcaaggtggaatcagcactattttaaatgatgcctatgatggtggaagattaaatttctggaattttaatcctaaccctttgcaaagacacaccttctggacaattattataggagggaccttcacatggaccagcatctacggtgtcaaccaatcccaggtgcagagatatatttcttgtaaaagcagattccaggcaaaactgtctctctacatcaatcttgtgggactctgggcaatcctcacatgctcagtgttttgtgggctcgccctatattccaggtaccatgactgtgatccttggacagccaagaaagtgtctgcaccagaccagctcatgccttatttggtactggacattctgcaagattatccaggacttcctggactttttgtggcctgtgcttacagtgggacattaagcacagtgtcctccagtattaatgccttagcagcagtaactgtggaagatctaatcaaaccttacttcagatcgctctcagaaaggtctctgtcttggatttcccaaggaatgagtgtggtgtatggagccctgtgtattggaatggctgcgctggcgtcacttatgggagctttgttgcaggcagcactcagcgtatttggtatggttggtggaccacttatgggcctgttcgctttgggcattttggttccctttgccaactcaattggagcacttgttggtctgatggctggatttgccatttctctatgggttggaattggagctcaaatatatcctccacttcctgagagaacattgccattgcaccttgatatccaaggctgtaacagcacctacaatgagacaaatttgatgacaaccacagaaatgccatttactactagtgtttttcaaatatacaatgttcaaaggactccactgatggataactggtattctttatcatatctgtacttcagcactgttggaactttggtaacattattagtggggatacttgtcagtttatcaacaggaggaagaaaacagaacttagaccccagatacatactaaccaaagaggactttttatccaattttgatatttttaagaaaaagaagcatgttttgagctataaatcacatccagtggaagatggtggaactgataatcctgctttcaaccacattgaattgaactcagatcagagtggcaagagcaatgggactcgtttgtgaagctgctctgatactagatatccttaaatgatgtttcaattttatatgttttctaagataattggatcaggttttctttgtgtgtgtgtgtgtgttgtatcatgagtgtttgggggataagtttttgttaaaacaaagtctggactatcttcatttactacatcattaattgatgttactctggagtttagaattctggcattgacatttccctctctttcctttatttcgatgaagctataattgtgaaaattgtaactacatagatgctgaaaggctaatacacacatatgcacatgtatttgattgtcaaaggtatattcttaaatttgggtattattgaaaatattttccatgccttggtgctagcatataagtttggaagtttgccaacatcacaattcatcttgaaaagagcttttttccctcctaccacatacaccattcttagggagcaatgaggtaacaggtctgtgttgtctagatctttgctttttatccccctatcagtccagggcatatactaacctgcaaactgattctgaatcaggaaggtggtaatcaataagtattctggctgggaaagaccgtgggcccaatgatcaaagtcttcttggtgctgttcattaattcttgtgccttttggcttgttttctagagtttctgggctttggctgctgatactgcctttcttagactgtaatttttatctgcatgcccagtttctgacctatcaacttgggttttattgtgcactctaactgagcttgtcttcataattttctgtttattgccctgggcttggatatgtctcaagacactcatgtgaatcatgccaccccaaatcctggcttatcaagtcccagactataaattatgaactcccattagcttggtactaacatatacttgatgtaggtatttatggacttgatgatccaagaatattatattcttcaaaatggttaagctccatggagttagatgactacacttaatgctattaagttgaacttttgaatgtcaactaatttgcaatcaattaaagatacatatgcctagaaattttgaaatttcggtatatttatccagttaaagggctaaattatataagcaaacactactttttttaaaacgtctggactcaaaaaatgctttgttccatgttttaaaatttttaagtagcagtctcaaagttgcttagctgtttattttgctatgttcctagctaagagtttggttataggagttcatcaataacttattttttgtacagttcccacattagatactgtttaaaagttcttttttaaactcaattttttttagaaacataagagaaatatttagatacatacaaatgtttttatgattaaataattttatgcttattttctgatacgtgttatttaggtaatcatgccctgtacatttagaggttgctaactgacaatgttaagaaattttaaaaaaaaaaaaaagcctgggcatgatggctcatgcttgtaatctgaacatttgggaggctgaggcaggaagatcgcttgaggtccagagtttaagtccagcctggaaacatagttagacctcatctctacaaaaataaaaaataaaaataaaaaaaacttagctaggcatgttgccacatacttgtagtcccagttattagggaagctgaggtgggaggatagcttaagcccaggatttcaaggctgcattgagctatgattacaccactgcactccagcctgggtaacagagtgaaatcttgtctctgggaaaaaaaa

SEQ ID NO: 19675 - DNA, 3165 bp, Homo sapiens
  ENST00000359674
agtgattagcctgtggagcaggaaagtccagcgatgggcagctggtcacggcagtgggtgaaagcaggggtggtcatctgacgaggggaggggaagcaggtggtgcccagcaaggtggaaggagaagtggacaggagaaacctcggggcattcccgagggcccaggaactgcaataaatgatcacagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcg

SEQ ID NO: 19676 - DNA, 1992 bp, Homo sapiens
  ENST00000545058
ttagcccctctaggctgtctctgaggttgggactgagctccgtgtgactcgagctgcctgtggggcgtggctggagggccactgcgtccccaccaggagtgaccttggcctgtccccccacctccaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgcc

SEQ ID NO: 19677 - DNA, 3332 bp, Homo sapiens
  ENST00000424061
gggtgtgaaggactacagagagagccaggttttggtgccatgcacacagggaaacttagagttcagagagggggtgtgatttgcctgaggtcacacagcaagttagagacccagctccacgactcattgtcttgctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccag

SEQ ID NO: 19678 - DNA, 2101 bp, Homo sapiens
  ENST00000536824
tctttctgtctgggagtccctggacaagtcacatgggattctgcgctgggaggaacagggtaaggcgtgaacgtggagggcagtttccctttcaggtcccggctctcttggctttcccataagcagctgccttgggactctcctggagacctgatgcccacagccaagctgaccacaggagccggtgctggggactgaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtag

SEQ ID NO: 19679 - DNA, 736 bp, Homo sapiens
  ENST00000542825
cccctctaggctgtctctgaggttgggactgagctccgtgtgactcgagctgcctgtggggcgtggctggagggccactgcgtccccaccaggagtgaccttggcctgtccccccacctccaggtggtttatttcacagccacgtttccgtacctgatgcttgtcattttgctgatcagaggtgtcacccttcccggagcctaccagggcatcatctactacttgaagccagatttgttccgcctcaaggaccctcagggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtat

SEQ ID NO: 19680 - DNA, 574 bp, Homo sapiens
  ENST00000535498
agatttgagcattatttccaacccagagagccggagactgtgcttcatgcctttttaaagccaggagtggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacag

SEQ ID NO: 19681 - DNA, 546 bp, Homo sapiens
  ENST00000544782
gcttagcccctctaggctgtctctgaggttgggactgagctccgtgtgactcgagctgcctgtggggcgtggctggagggccactgcgtccccaccaggagtgaccttggcctgtccccccacctccaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgccctta

SEQ ID NO: 19682 - DNA, 741 bp, Homo sapiens
  ENST00000538272
gcggcggacgcccgggccgccccaacgccgctgcgcggtggagaccgcggtggaacccgtccttgccagggtgggctcgccgggccccaaaggagaggttttgttcatagtcagcattgatttttcagccaggctgttctgaaaggtccacagtccttcgttaagtagtgagcacttcgggaggctgaggcaggaggatcgcctgagcccgggagttcgagaccagcctgggcagcatagcattggtctggcatctgtggtcatcgagtcatatttgaatgtctactacatcatcatccttgcctgggctctcttctacctgttcagctccttcacttctgagctgccctggacgacctgcaacaacttttggaacacaggagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaac

SEQ ID NO: 19683 - DNA, 557 bp, Homo sapiens
  ENST00000540094
gggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtatgtaccgtgctgggaccacttccccaggtgccttccccacccagccaggtctgtagttttgaaagtcttgtatagctttttccttggtttaaaagcaataaatgcccactggagataaattag

SEQ ID NO: 19684 - DNA, 665 bp, Homo sapiens
  ENST00000538580
tctgagctgccctggacgacctgcaacaacttttggaacacagagcattgcacggactttctgaaccactcaggagccggcacagtgaccccatttgagaattttacctcacctgtcatggaattctgggagtaggtgctgggcccatttgccacatatgaagaggaaatttggatgtctgagctgtgcaagtctgaatgtctggggtgcaagtttaagattctgtgtgtgctttccagcacttcctcccccgccccactccaaccccacacatcactgaggcaggggagaacgctctcacatctacccacacgggtccacggagactcacatttatccgtcatgtccaccttcagccccacatccctacctccatgcgtgtgtctgcccacacatgtccagtggggtgctggacagagtcttcacagctttaggggagctgagtgtgcatgtctcttcccactgccatgctcggtggtgtcatgccagtagcttgaaattgcccaaggcgggagtgctcacatcaagacatgggcacaccctccactcacacactcaccctctcacctgacaacgtaccccttcacattacgtgtgcccacactcgtccacctgcattcccacgcaagactgcctgtactctctcacactgagctaacccccac

SEQ ID NO: 19685 - DNA, 549 bp, Homo sapiens
  ENST00000536116
cccgagggcccaggaactgcaataaatgatcacagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacag

SEQ ID NO: 19686 - DNA, 577 bp, Homo sapiens
  ENST00000537793
atccctgtttctctagagccttggaggagcgtggggcacttggtagacctggtcgctttgattccctcaatacccctcagaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagc

SEQ ID NO: 19687 - DNA, 554 bp, Homo sapiens
  ENST00000535347
acatgggattctgcgctgggaggaacagggtaaggcgtgaacgtggagggcagtttccctttcaggtcccggctctcttggctttcccataagcagctgccttgggactctcctggagacctgatgcccacagccaagctgaccacaggagccggtgctggggactgagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctgg

SEQ ID NO: 19688 - DNA, 567 bp, Homo sapiens
  ENST00000537826
tatagcctggagtctctgtttccctttcaggtcccggctctcttggctttcccataagcagctgccttgggactctcctggagacctgatgcccacagccaagctgaccacaggagccggtgctggggactgagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggtgagttcactttgaggtaggcatggtggggagagctgtgtgctggcagctgggcagtgcctacctgggccctcctt

SEQ ID NO: 19689 - DNA, 467 bp, Homo sapiens
  ENST00000538424
atccagcgtgggagcagctcagtgattagcctgtggagcaggaaagtccagcgatgggcagctggtcacggcagtgggtgaaagcaggggtggtcatctgacgaggggaggggaagcaggtggtgcccagcaaggtggaaggagaagtggacaggagaaacctcggggcattcccgagggcccaggaactgcaataaatgatcacaggtgaggggttcctgcccgctgcctgccggctgagcgtgacgagctgggtgccaggcgcctcccaggaggaagctgtcttggctttgggcggtggatgctatgggtgtgcttgtacccgaggggggcactcaggggagttgcaggcagccaccagctgagaccggcactcacggggtgtgaaggactacagagagagccaggttttggtgccatgcacacagggaaacttagagttcagagagggggtgtgatttgcctga

SEQ ID NO: 19690 - DNA, 3294 bp, Homo sapiens
  ENST00000397296
gttcagaggccccaccttctcttttcctcccaatcagctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcg

SEQ ID NO: 19691 - DNA, 2185 bp, Homo sapiens
  ENST00000343164
agataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccttgtggggctgatcatgctcacagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgc

SEQ ID NO: 19692 - DNA, 425 bp, Homo sapiens
  ENST00000539668
catggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccttgtggggctgatcatgctcacagaggaacgacaaagtaggcaggtccctcctctggcctttgggcatggaccacccacctccagggatgggtgaggagccatttggctccacagtaagtgaagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatgg

SEQ ID NO: 19693 - DNA, 340 bp, Homo sapiens
  ENST00000542379
cgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccagggcggaatgtacgtgttccagctctttgactactatgcggccagtggcatgtgcctcctgttcgtggccatcttcgagtccctctgtgtggcttgggtttacggtgagtgactcctcccct

SEQ ID NO: 19694 - DNA, 494 bp, Homo sapiens
  ENST00000543722
tttgcgtggtcctctgaattctgccaggtagccctgctccggcgtccgtgaaggggccaggacagtgtccgccaggaggggctgtgctcccagacaggaagcaggagaggttgcagccctgttctgaccctgccattccgccctctcctcacccctgccccacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagaaagcctggtgacagcgctggtggacatgtaccctcacgtgttccgcaagaagaaccggagggaagtcctcatccttggagtatctgtcgt

SEQ ID NO: 19695 - DNA, 490 bp, Homo sapiens
  ENST00000542947
acgctgaaacacagctgaagtgaaatcatatggtgcctctcaaaattgaattcaggcgactaagagttatttgttgtttgggattacccattagcatgccagatgggatgatggcagagtggtggcgtcccatgcggtgtggacctacgtggtagagaggggcggctgtgtggcggtttgtcacatctagatccatgttttgcttccctggagccgcattcttttaggactaccttgatttattccgtccctgggctggtggggccgaggagtgtcggaggagagccagtgctttgcgtggtcctctgaattctgccagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgct

SEQ ID NO: 19696 - DNA, 541 bp, Homo sapiens
  ENST00000546319
cacactttaaatagccagcaccttctccttcccccttagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacc

SEQ ID NO: 19697 - DNA, 1001 bp, Homo sapiens
  ENST00000536842
agataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggttcgtgtggggagctcctgcccctcccattcccggactcctgccctcactgggggctgtcacccaggagttctctaagctgtggccccgttgaggatgggaggcgatgacccagcgaggatttgatgtggctcccttccttgattctccgcctctcctagactcacatacttctggtttttgggactggaagagagcgagaaaggcaggaaggacacctccagggtaatctgatcttggaactgacgatgg

SEQ ID NO: 19698 - DNA, 525 bp, Homo sapiens
  ENST00000534887
gttagcatgccttgaagcagctgacctgaagagcacctttcctgttgccatctgatcatgcttgaggagaatgtatacccaagcatctatgtacccacatgtccaagtgtgcgggagagagtgagctgcatttgttgaggttattacgtgtgggaggatgttttgtacagataaccttagcctggctcctgccaaataccttccttcccattctcctagaatttcaccccactctccagttgtgtcataggctggctgatgatttttctcttttttccctcctcgtgacccatgggtagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggttcgtgt

SEQ ID NO: 19699 - DNA, 607 bp, Homo sapiens
  ENST00000539260
ctggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgaggtttccccgcaggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctggga

SEQ ID NO: 19700 - DNA, 560 bp, Homo sapiens
  ENST00000542272
agataattcttctcccctgactggacctctggcagcagcttcactaaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacaggtggtgactttgcacaggacgcttacatagaaatgttagcatgccttgaagcagctgacctgaagagcacctttcctgttgccatctgatcatgcttgaggagaatgtatacccaagcatctatgtacccacatgtccaagtgtgcgggagagagtgagctgcatttgttgagaacactgtatggagttccagaagaccaacggctccctgaatggtacctctgagaatgccacct

SEQ ID NO: 19701 - DNA, 1101 bp, Homo sapiens
  ENST00000436453
agataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgagatgagagcccttgtgccaccccacccactcctggaaggaggatacttccatctcctgcacttacggcccctctggggagtcccatagatgtatagaattctggaggtaggaggacgcttagaggtcattaaggacactctgtaagagactaagacctagaaaggttacgtgactatcccagggctctttctattataacgtggcatcgtagaaatatgagcacaagctggaaccaggtggatgagagtttggattctggctctgctacttaacactctgtgtgatcttggacaagttacttaagctctcagagcatcaattgccgctcctgcaaattgagataataatgcctgcctttcaaggtcattgtaaggattagagacaatgtgtgtaaagcacttaataaatagtagctctgctgatgatgacgttgataaccaaactgttctgtggtcttaagtaataaatagtagctctgctgatgatgacgttgataaccaaactgttctgtggtcttaagtaataagtagtagctctgttgatgatgacgttgataaccaaactgttctgtggtcttaagtaataagtagtagctctgctgatgatgacgttgataaccaaactgttctgtggtcttaagtaataaatagtagctctgctgatgatgatgttgataaccaaactgttctgtggtcttaagtaataaatagtagctctgctgatgatgacgttgataaccaaactgttctgtggtcttaagtaataaatagtagctctgctgatgatgacgttgataaccaaactgttctgtggtcttaagtaataaatagtagctctgctg

SEQ ID NO: 19702 - DNA, 1950 bp, Homo sapiens
  ENST00000445055
cacactttaaatagccagcaccttctccttcccccttagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccttgtggggctgatcatgctcacagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgctgac

SEQ ID NO: 19703 - DNA, 3739 bp, Homo sapiens
  ENST00000230671
agaaagccgagggtttccgtcgcgaacccccctccccactcgctcagggctctccaatccgcagctctgcgtgcgggggcgcgcgcatccccccgccgtccgtccgtcagctgtctgtctgggtgtctatgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagttctccagcctagggcccctggctgtctggaaaatcagccctctcttcaaaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagcgaggagtactggagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtggtgtatttcacggccacgttcccctacctcatcctgctcatgctgctggtccgcggagtcaccctcccaggggcctggaagggcatccagttctatctcaccccccagttccaccacttgttgtcttccaaggtgtggattgaagctgctcttcagatcttctattccctgggtgtgggcttcggggggctcctcacctttgcctcctacaacacgtttcaccagaacatctatagagacactttcatcgtcactctgggcaacgccatcaccagcatcctggctggctttgccatcttctccgtgctgggctacatgtctcaggagctgggcgtgcctgtggaccaagtagccaaagcaggccctggcctggcctttgtcgtctacccacaggccatgaccatgctgcctctgtcacccttctggtcctttctcttcttcttcatgcttctgactctcggcctagatagccagtttgcttttctggagaccattgtgacagctgtgacagatgagttcccatactacctgcggcccaagaaggcggtgttctcagggctcatctgcgtggccatgtacctgatggggctgatcctcaccactgatgggggcatgtactggctggtccttctggatgactacagcgccagcttcgggctgatggtggtggttatcaccacgtgccttgccgtgacacgggtgtatggcattcagaggttctgccgagacatccacatgatgctgggcttcaagccgggcctctacttcagggcctgctggctgttcctgtccccagccacgctcttggccctcatggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggagcggctccaacaggccagccggccggccatggactggggaccatcgctggaggagaaccggacgggcatgtatgtggccacgctggctgggagccagtcaccaaagccactgatggtgcacatgcgcaagtacgggggcatcaccagcttcgagaacacggccatcgaggtggaccgtgagattgcagaggaggaggagtcgatgatgtgaggcaggaggcaggcgggcagaaggccctgcccgggacctcacagtcccttcttagaagcctgcaaaggtcagctgtgccctctgggattctgagaggctatgggggggcctgccatagggatgccagtcccccagtgggggtcccttctgcagcctctgcctctcctgaaacctctgacaaccccctacacacacacacaggcatactcagacccactcaaagctgagaatgatccaactcagccctactttgcggatggacatattaaggccaggaggggagggacttgccccaggtcgcatggcagaggggacttgaacccacgcctcctgaccagccagctccctttcccatggggcagccggcaccaccttctcatctctattcagggcctacacccctccctttttggggggagcctgtccccacacaccttagcacaaccagaatcttgagttgggcagggaaggtcagggctacagaggctcttgaggctccgaggccctggggatcaaaggtcaatgagttaggtggggagaaagatccctgggggctcctgtatgcaggactcctgaaggaggtgggagctgagggccctggaggatggggaaggtttgcagagagaggaagaagagggcagggtggggaggagctctgggccagaggatgctgagctgcctgggcagagaccaagagggttggagacactagttttaccaggttacaggagggttcaagacagaaggaaaactaacagagggggagccagggatgatggggtgggcaggggatttgcatgatgaggagtatcattccagatctgtgcagagcggatcggacgggacagggtggagcggggaggcctgtgcaaagtgggaaagagctgccggtggcctgagccagggtgctggggctgcgggtggggaaaggaggccccagcacttcagacaaagaccaccccttcacccactggaccccaagccgcaaaagctggggaggtaggaagggtcactgtgagggcccagggcccctctcttcccatctcccttgtcctggtggccttcagtgtctcttccagttccaggagctgctgggaagctggccttcattgttggtgacagggcaaccatgggactaggaggtggcccatacacatggctggctggtcctgaggccacccaccttgttccaggacatgggcccgggcccggtgtgggggtagacgcagagggcagagggtagcccttggtactgtgggtccctcaaagaggagagtggggtgcagaaatgcctcagcatggctcatgcacacagcattctcccgtggggcagggttccctcatgcaacaggcctccctgtggccagcctctctgcctgtctctcgctgcgtccccccaaccccttgtgttctattggttcattgttaataaatatcaaatgaggtcacgctcctta

SEQ ID NO: 19704 - DNA, 2431 bp, Homo sapiens
  ENST00000524041
atgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagttctccagcctagggcccctggctgtctggaaaatcagccctctcttcaaaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagcgaggagtactggagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtggtgtatttcacggccacgttcccctacctcatcctgctcatgctgctggtccgcggagtcaccctcccaggggcctggaagggcatccagttctatctcaccccccagttccaccacttgttgtcttccaaggtgtggattgaagctgctcttcagatcttctattccctgggtgtgggcttcggggggctcctcacctttgcctcctacaacacgtttcaccagaacatctatagagacactttcatcgtcactctgggcaacgccatcaccagcatcctggctggctttgccatcttctccgtgctgggctacatgtctcaggagctgggcgtgcctgtggaccaagtagccaaagcaggccctggcctggcctttgtcgtctacccacaggccatgaccatgctgcctctgtcacccttctggtcctttctcttcttcttcatgcttctgactctcggcctagatagccagtttgcttttctggagaccattgtgacagctgtgacagatgagttcccatactacctgcggcccaagaaggcggtgttctcagggctcatctgcgtggccatgtacctgatggggctgatcctcaccactgatgggggcatgtactggctggtccttctggatgactacagcgccagcttcgggctgatggtggtggttatcaccacgtgccttgccgtgacacgggtgtatggcattcagaggttctgccgagacatccacatgatgctgggcttcaagccgggcctctacttcagggcctgctggctgttcctgtccccagccacgctcttggccctcatggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggagcggctccaacaggccagccggccggccatggactggggaccatcgctggaggagaaccggacgggcatgtatgtggccacgctggctgggagccagtcaccaaagccactgatggtgcacatgcgcaagggcacatctgctaggggtcttctctatgcaagaatgacagtatctgccacgtacatccggagcacggacaagatgctgtcctgccttcaaggagcacacagttctgcagaaacttgcttaggtgacttcaaaccagagatctgtggtgaggaagtgacggtggtggggtgatgacatgggagaattccagcaaaatccacctgggagaaccagcagctccactccacggacagagtggatctctgcggcacagcaacgcagcgaccccagcctggtccctcagctgtaagacacacacggggtgcttctcagggcatggtgtttcctgcttgggcaacccacccaccctgccgcttta

SEQ ID NO: 19705 - DNA, 587 bp, Homo sapiens
  ENST00000513403
gtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggtatgggcctgaggtcctgtcggagggtgtctggggtgatgggccaaggccctggggtacagtgagcttttaggtggcctcagccactgtctcctaggcgaccttgggcagaactcattgaaagtggtttatagtaacttggggctgggaggaaggagtttaccctgtcttgtccttctcatcacccaagcccttccttcctccctctcatccccaggaaggatacccacatggttccctctctaaggctggccaccccacgccctgcacggtgggcagagggagctgcctct

SEQ ID NO: 19706 - DNA, 7347 bp, Homo sapiens
  ENST00000380752
gcactgctgatgaaacctggcgccggaacccgccagccctcggcgcccattcagtccgcgcaggcaggtgtgagcagcgggtcaactacctggcaggcgcgcacgcggccgcgggctcccgctaaccgcagcctccactcctctccccgcgcgccgcgcccccgccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctgggctttttaccagaggcagagatgttctctttgaaaaccatactctcacccaaaaacatggagccttccaaaatctctgggctaattgtgaacatttcaaccagcctcatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtgtctcctcacttctctgaacaaagcagttcctcccctaccagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagatgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagacagtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggatgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgagcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtggggggcacgtggacatgccccataggggccccacccagacttaacaggcaaggtcctgggcattgcgcgacgcaggactcaatgctaaagcaagcctgcctggctctgtgccagggcccctcttctgattcacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgattactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcactcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccatgtg

SEQ ID NO: 19707 - DNA, 726 bp, Homo sapiens
  ENST00000473577
acctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctgggctttttaccagaggcagagatgttctctttgaaaaccatactctcacccaaaaacatggagccttccaaaatctctgggctaattgtgaacatttcaaccagcctcatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggtgagcagctcggcctagggaaggaaccctggtacacagaccctggccctcctgatgcctggccagccctgcgtgggctcagccgggcctgggtgctcccgaggaaggtttttgctagccagcttcaggtaagatggggcaggggtcctgaaggcacagagaggaccagaccctggaaggaggcagcagcccttctcccctggacgtttccctgagtagtcaagggcaggctgacaccttcctgcatgacacaggccaagagagacctcgccagtcc

SEQ ID NO: 19708 - DNA, 547 bp, Homo sapiens
  ENST00000450494
gatgtggccagtggtgtggatgtgaatattcatccctgtggaggaaaatagtggggtctctgagatttgattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacat

SEQ ID NO: 19709 - DNA, 1946 bp, Homo sapiens
  ENST00000253188
agtcccgggcccggagccagcgcatgcgcccgcctgtgggcgctgtcccggctgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgggaacatcatcggctcgggcatcttcatctcgcccaagggggtcctggagcactcaggctccgtgggtctggccctgttcgtctgggtcctgggtgggggcgtgacggctctgggctccctctgctatgcagagctgggagtcgccatccccaagtctggcggggactacgcctacgtcacagagatcttcgggggcctggctggctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaatgcggtggctgtgaccttcggggagaagctgctgggctacttttcttgggtcatgcctgtctccgtggctctgtcaaccttcggagggatcaatggttacctgttcacctactccaggctgtgcttctctggagcccgcgaggggcacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgtttaaggaagccctaaaatgtggactgggtttcctgtcttagcactgccctgctagctcttcctgaaaaggcctataaataaacagggctggctgttc

SEQ ID NO: 19710 - DNA, 1462 bp, Homo sapiens
  ENST00000590490
ctgtgtctcgggcagcaatgctgccccctttcctgccccaacatccccagcagacacaagagatggagactatgagctgctctcgtggctgggtctcgggggtcctgcaccctcaggagctgacgctgacgcactccactgcctgtcaccaggaacctacctcgcgccatcttcatctccatcccactggtgaccttcgtgtacacgttcaccaacattgcctacttcacggccatgtccccccaggagctgctctcctccaatgcggtggctgtggtgagtgggcccctgctcggtccctggctcctgcccaggcccctgccccggccttacacatggcctctctactgtgcccacccagaccttcggggagaagctgctgggctacttttcttgggtcatgcctgtctccgtggctctgtcaaccttcggagggatcaatggttacctgttcacctactccaggtgactgcactggggagacgtgggcatggggagggaaggctggggtgcaggtgtgcaccagtcatgccgtgggccagaggaagggacacctgccgggggaggggtctgcctgaagctgggatgatgatcccacacggtaacaagtgtctgatcacaactgggaggcaaagaaagcaagaggcaggcaggctggatgagggggagaactgtccagtggggctgctgggcccggagcaggaggtcagaggcgacagcttaagagggacatcaggtccaaagctgagacccaggatgtggccagtgcccatatctgtccccaacgctaggctgtgcttctctggagcccgcgaggggcacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacga

SEQ ID NO: 19711 - DNA, 1641 bp, Homo sapiens
  ENST00000590036
tgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgggaacatcatcggctcgggcatcttcatctcgcccaagggggtcctggagcactcaggctccgtgggtctggccctgttcgtctgggtcctgggtgggggcgtgacggctctgggctccctctgctatgcagagctgggagtcgccatccccaagtctggcggggactacgcctacgtcacagagatcttcgggggcctggctggctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaatgcggtggctgtgaccttcggggagaagctgctgggctacttttcttgggtcatgcctgtctccgtggctctgtcaaccttcggagggatcaatggttacctgttcacctactccagtgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaa

SEQ ID NO: 19712 - DNA, 789 bp, Homo sapiens
  ENST00000587064
tgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaa

SEQ ID NO: 19713 - DNA, 1431 bp, Homo sapiens
  ENST00000592596
tgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagtgagtggggcccccaactgggccctgggaagcagccaggccctctggtgggacaggcagcctctccgcccagccccactgccacccaaggctcgggctggtcctcggtggcccacgcctgttgccctgcaaaaatggccctgggaagaaagccggggggcttgcattctagcctggccctgttctctctggctatggacacgtcacagccccttgcagggcctcagaaaggctgaatatcatcatcctgctgtaaatagatccagagatttgcatttggcctaaaattatgcatatacacacaatatggtccctacaaatgaagccaatgactgcgtctgatgctcggccagggatctcgacagtaaacctttgcagctgagcgagctgggactggaaagttccaggaagactctgggtctgtggactgggctctggggccattttggggaattttccaggctgattttggctgtatgcgattttatctttctgcacagacatcagaccctgtcctcaggatgtgatggggcccctcccccatctcccatcctaccagcctgtgtccaggtgggggtggggcagggcagacaacagggtccctgtgtctcgggcagcaatgctgccccctttcctgccccaacatccccagcagacacaagagatggagactatgagctgctctcgtggctgggtctcgggggtcctgcaccctcaggagctgacgctgacgcactccactgcctgtcacca

SEQ ID NO: 19714 - DNA, 797 bp, Homo sapiens
  ENST00000509248
gcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaccttttctgagcggctactgggaaatttctcattagcagttccgatctttgttgccctctcctgctttggctccatgaacggtggtgtgtttgctgtctccagcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcggagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaagga

SEQ ID NO: 19715 - DNA, 9645 bp, Homo sapiens
  ENST00000280612
ggtttgtaatgatagggcggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcggagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttataactctatgtagttatagaaagtgaatatgcagttattctatgagtcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaaagatggttttacacactatagatgtctatactgtgaaaagtgttttcaattctgaaaaaaagcatacatcatgattatggcaaagaggagagaaagaaatttattttacattgacattgcattgcttccccttagataccaatttagataacaaacactcatgctttaatggattatacccagagcactttgaacaaaggtcagtggggattgttgaatacattaaagaagagtttctaggggctactgtttatgagacacatccaggagttatgtttaagtaaaaatccttgagaatttattatgtcagatgttttttcattcattatcaggaagttttagttatctgtcatttttttttttcacatcagtttgatcaggaaagtgtataacacatcttagagcaagagttagtttggtattaaatcctcattagaacaaccacctgtttcactaataacttacccctgatgagtctatctaaacatatgcattttaagccttcaaattacattatcaacatgagagaaatcaccaacaaagaagatgttcaaaataatagtcccatatctgtaatcatatctacatgcaatgttagtaattctgaagttttttaaatttatggctatttttacacgatgatgaattttgacagtttgtgcattttctttatacattttatattcttctgttaaaatatctcttcagatgaaactgtccagattaattaggaaaaggcatatattaacataaaaattgcaaaagaaatgtcgctgtaaataagatttacaactgatgtttctagaaaatttccacttctatatctaggctttgtcagtaatttccacaccttaattatcattcaacttgcaaaagagacaactgataagaagaaaattgaaatgagaatctgtggataagtgtttgtgttcagaagatgttgttttgccagtattagaaaatactgtgagccgggcatggtggcttacatctgtaatcccagcactttgggaggctgagggggtggatcacctgaggtcgggagttctagaccagcctgaccaacatggagaaaccccatctctactaaaaatacaaaattagctgggcatggtggcacatgctggtaatctcagctattgaggaggctgaggcaggagaattgcttgaacccgggaggcggaggttgcagtgagccaagattgcaccactgtactccagcctgggtgacaaagtcagactccatctccaaaaaaaaaagattatatatatatatatatgtgtgtgtatgtgtgtgtgtgtgtgtgtgtgtatatatatatatatatatatacacacacacacacacactttttatatatatatatatatatatatagtggaacttacaaatgagagtaatataatgatgaaattttgaactgttatttataaacatctaaggtaaaatggttagtcatggccagagtatgtttcatcctttaatttttgtccatttgaaaataaggatttttgaaagaattataccaattaaaattattaaaggcaaacatagaattcataaaaaattgtccaaagtagaaatgatgacctataatttggagcatttccaattcagtaatttcaattttgctcttgaaaacatttaatatatatccaagactgacatttctttagctgaacctaacgtttgggtctctgagtgaatttataataactccttccttccttagcatagggttttcaaaatttgatttataattcctatttccagtaaatattgttcatttgtccacatctctccctatgatatgttgctggaggtaagaatttctttcatattcctattttttttttccccatagactaggctcatagaatttaaacaagcaaattttcctgagctttttcttgccaaatgaaagaagactggtaaattctcatagagaggtttgtgtagttcttggctcttcctggggttaatgtgcttatattcacagtggcaaattggtctcagactttaatttatttatttttgatttgaatttctctttaaaagtatcaatttaaaaggtaactagaattattctttctcattttcaaaagtgatttttgcattattaaatttccctgccattgtaatgccatttcacgcagaaaaaaagtcagccagtaattaagaaaaaaagtgatggagattaagtagtattttggcttatttttaggactcatcatgagaagacacagttcctttaatcaggaaattaatatccataattttcactcaaaattgcagtatgtaaagcagattctcaaaaactctcctgaacacttatttatatatatgtttttatataagtaaaatttttctcatatttttatacgatatgcacacacacacatacatgcacatactacttactacatgttctgtacttgtactttgtaccatgcatattcaaatgtttatatacataagtttattataacataaacagtaaaagtaatgaatactgtttaaaataactaatatagtattttttaatttttgtggggatggattctcaaatacttgtgattttaaaagattctaaagctaaaacacaacttgattttaaaaagaatgattctccttacacaattataaatatttgcagtaaatattttccttataatactgttttgaccccatttaaaaagtattagattatattcctttgatccaatgaaaactgaaccttataaatggttagctgaaagtagaccttattcttgtccttctttagaagagtaaagatttgtcctagggaagatggctgacttcggttcccaacatgcgtatgcatttagactgtagctcctcagccctgtggacacaaaatttggacagcttattaggttacgttagcaatgcatgacggtttctccaacactaagatattcacgttgaaacagatttcctgttcgtcttatgtgtctggtaaaattgtttccccaattacaatttgacatatcaatagagggttaacaagagtataattacataacagaattcctcatgaactgtaatcagtctacaggaaaatcattattttatcttgatttgcagatgaatatactgctaagaaagggagcaactctgacctttgttaaagttgatcttttgtaattgaggtataaggtatgaaaagataaaaaaccgaaggccagagaatcaggaaatgaaagatagtatggactgaaggtaacaatattttaatgttatgcaatatagtcagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaattttgttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgaaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaaaaaaaaaaaaaaaaaaaaaaagatttttaaataatagctaaaggtatgctctctaggtcatccttagtttattagtactgtacttaaaaattattttttaatagtcaattttgggagataattatttctttccttatattttccaattagttggtgtctaaaaataaatgttttgtctaattttagatcaggtatacattcacaaaagcataaatcatagtctcacaggaaattcaccaattttccatatgtcgtgagataactgtcctttctacaacctcataacaatgaatttatataattacctagattttcttagtgtgaatctacccattagttttattttcttggtagttatttttttccctcctctctgttactattggccttaaaatacacagaggacggttacagtgtcctaatagctgttacatgtgtgtgtttcagcgtacttgaatcaagtgtacatttatagtaccaataaccgcctttacagctttacagttaacaattctctcacaaaactgtagagcattaggcatctgagagccatagagggccaactttgttccagagtgaacatgctttttttcctcaacatatacactactgattttttttaaaagtatgactttcaagtgaattaatgtattggttaggagaactgcttgctaagtccttattacctcttgttaaagcctcagaaggccgtgctgaaagccagaggggaaaaaaagagtaatgcacaggtatctcttttgcagtggtgactgtattttgagtaccttgtgtgacagggtattattacagcatcttgtgggaaaacctattaggcctttgcatgttaaagctgtataatttgttgggttgtgagtggtctgacttaaatgtgtattataaaatttagacatcaaattttcctactaactaactttattagatgcatacttggaagcacagtcatatcacactgggaggcaatgcaatgtggttacctggtcctaggtttgaactgtcttatttcaaaagatttctgaattaatttttccctagaatttctccttcattccaaagtacaaacatactttgaagaatgaaacagattgttcccatgaatgtatgctcatactcgactagaaacgatctatgttaaatgactgtgtatatgaattatttcaagtactaccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatattttgctttaaaatatattttggttattttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttgtactgaatacttcggcaaacttattgggtcttcattttctgacagacaggatttgactcaatatttgtagagcttgcgtagaatggattacatggtagtgatgcactggtagaaatggtttttagttattgactcagaattcatctcaggatgaatcttttatgtctttttattgtaagcatatctgaatttactttataaagatggttttagaaagctttgtctaaaaatttggcctaggaatggtaacttcattttcagttgccaaggggtagaaaaataatatgtgtgttgttatgtttatgttaacatattattaggtactatctatgaatgtatttaaatatttttcatattctgtgacaagcatttataatttgcaacaagtggagtccatttagcccagtgggaaagtcttggaactcaggttacccttgaaggatatgctggcagccatctctttgatctgtgcttaaactgtaatttatagaccagctaaatccctaacttggatctggaatgcattagttatgaccttgtaccattcccagaatttcaggggcatcgtgggtttggtctagtgattgaaaacacaagaacagagagatccagctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataa

SEQ ID NO: 19716 - DNA, 10103 bp, Homo sapiens
  ENST00000231706
atctgaataattgaggagctgttcagcagcagcggctgcctcctgccttcctttgccgccaccaccacttcccatcccagctagagagacagctccgcgcagtaagtgcggactgccagccaccagccttggcagccagctcgtcgcctccagccccgaccccgacattcatgcccaggagaaggctgcactgggtccctctgggcctttcctaaaagggagatccctgttcactagatgagttccagaaccatccactaaggctttgtagcccccttccatcagctgaccttcactgcatcccctatcgctcaagatgagtggcttcttcacctcgctggacccccggcgggtgcagtggggagctgcctggtatgcaatgcactccaggatcctacgcaccaaaccagtggagtccatgctagagggaactgggaccaccacggcacatggaactaagctagcccaggtactcaccacagtggacctcatctctcttggcgttggcagctgtgtgggcactggcatgtatgtggtctctggcctggtggccaaggaaatggcaggacctggtgtcattgtgtccttcatcattgcagccgtcgcatccatattatcaggcgtctgctatgcagagtttggagttcgagtccccaagaccacaggatctgcctacacctacagctatgtcactgttggggaatttgtggcatttttcattggctggaacctgatcctggagtacctgattggcactgcggccggagccagtgctctgagcagcatgtttgactcactagccaaccacaccatcagccgctggatggcggacagcgtgggaaccctcaatggcctggggaaaggtgaagaatcatacccagaccttctggctctgttgatcgcggtcatcgtgaccatcattgttgctctgggggtgaagaattccataggcttcaacaatgttctcaatgtgctgaacctggcagtatgggtgttcatcatgatcgcaggcctcttcttcatcaatgggaaatactgggcggagggccagttcttgccccacggctggtcaggggtgctgcaaggagcagcaacatgcttctacgctttcattggctttgacatcatcgccaccactggagaggaagccaagaatcccaacacgtccatcccttatgctatcactgcctccctggtcatctgcctgacagcatatgtgtctgtgagcgtgatcttaactctgatggtgccatattataccattgacacggaatccccactcatggagatgtttgtggctcatgggttctatgctgccaaattcgtagtggccattgggtcggttgcaggactgacagtcagcttgctggggtccctcttcccgatgccgagggtcatttatgccatggctggtgacgggctccttttcaggttcctggctcacgtcagctcctacacagagacaccagtggtggcctgcatcgtgtcggggttcctggcagcgctcctcgcactgttggtcagcttgagagacctgatagagatgatgtctatcggcacgctcctggcctacaccttggtctctgtctgtgtcttgctccttcgataccaacctgagagtgacattgatggttttgtcaagttcttgtctgaggagcacaccaagaagaaggagggcattctggctgactgtgagaaggaagcttgttctcctgtgagtgagggggatgagttttctggcccagccaccaacacatgtggggccaagaacttaccatccttgggagacaatgagatgctcatagggaaatcagacaagtcaacctacaacgtcaaccaccccaattacggcaccgtggacatgaccacaggcatagaagctgatgaatccgaaaatatttatctcatcaagttaaagaagctgattgggcctcattattacaccatgagaatccggctgggccttccaggcaaaatggaccggcccacagcagcgacggggcacacggtgaccatctgcgtgctcctgctcttcatcctcatgttcatcttctgctccttcatcatctttggttctgactacatctcagagcagagctggtgggccatccttctggttgttctgatggtgctgctgatcagcaccctggtgtttgtgatcctgcagcagccagagaaccccaagaagctgccctacatggccccttgcctcccctttgtgcctgcctttgccatgctggtgaacatctatctcatgctaaagctctccaccatcacatggatccggtttgcggtctggtgctttgtgggtctgctcatttattttggatatggcatctggaacagcaccctggaaatcagcgctcgagaagaggccctgcaccaaagcacgtaccaacgctacgacgtggatgaccccttctcagtggaggagggtttctcctacgccacagagggcgagagccaggaggactggggcgggcccactgaagacaaaggcttctattaccaacagatgtcagatgcgaaggcaaacggccggacaagtagcaaagcgaagagcaaaagcaaacacaaacagaactcagaggccctgattgcaaatgatgagttagattactctccagagtaggagaaacacacaagtgggtagaaatggtgatgactgattttcagtaacttaacctgtgggctagaaggtgaaaacttttttggctctcatttcacaaatccagccttccccaaattcaatccctagtcatagcctgtcatttgctacttttgctcttcaggatagttctgttgaagggcttaacctgggtcccctaactggtcgccttgttaaataaaataaataaataaacaagaggctatatgaaattccatcttaggtgcaaccaccagagctgatggtaccaaatgtttcctaggcctttgctttgctggttgaagcccaagcaggggctctgggcagaaggcagaatttcagtcacctgagacatggggacaaagctctgttcttggcatgtcaggctgagtgctgctccccgaggtcagggtgggtagatgggcattggcacttcctgagcaagcatcattttatcctgcaatctcacccaaaattaattcatggaaaagacacatgcttctttttattcaccaacattctcacagcttccaaactataattttaggatccagcaaagttcagggactctggaccattttcccaatggtttcagattcaccataaagcagtcaggcagacccagtgatatggtaagaagcaccatcaaagctctatgtaaatgcccagaagaaaattaaataaccatatcttgcggtaaaagccagaagggcattggcagaaattaactctctgtcatggcctctcttatatcagactgcagctcctggtgatatgatgaaagcgggcaaaggtggagcatgatttcatggcactgatatgccttgaaaaagtaggttgtttgttttataatcagataaaaatttttacaaggagaagtgagccagccactgagatcacattgcaaattctctttcatatttctaaaattataaattctaaagtttttgagataggcaaccacttgattggtgtgtgctactctgaaaacaaaataggctgaagtatagcgacttaggtagttgcattccatgagatcacatttcacttctgaaccttattccttggggctagctcactttcagaggtgtatttttttttcctgttatttcccagagtagtttcactgaagcccagagaaatatctacctggtaagatgtaaatttgggccataaaaggggctattaaaagaattttctcagaaatagaatagatgagagaatttgcaaaggaaaaaaacacacatgggctacaatataaattctactcttgggttacaagaattcctgtggctgcactgagatacgtacaaatgtatgtgaaggcacaatttgaatcaagctatcatagaattaaccaagctattaaaattaatcaagctattaataaaatctctgtgaggatttcctgaaagagggacaaaagaagaaattccttgtcctttctctcctggatgtatcagtatgccaaacgttttccagaacatattcgctagcactcaagtctgttctttctgaaaggctgaggctcatgccatcttggcatgctttaggattatggcaaggaggtaaaagtccattttttcattcaactaacactggttgagaatagacccaatgctaagtgacaggaatgaatagaagcatggcacttgcccttgggggctacagtccatggatgagcagcactggagcctggtaaatgcagataaaacaacaaacttgacaagtctccaggctgatgcactgggttttaacatacatataaagatgaattgaaactagtttttaaaaaatatgctttaaataaattacatatcgtaatcatagccaatgtataccattaaactaaaataactgcaattttctagatattttttattcttctgtagtcattgtttagaactctggtttcctgaggtcattttgtcattttaatatcatgcttgacaatgctatgttttctcttccctagagttaaccataaagatacagtgcctactctgtgaaatacagcattaggaattaattataaactaattatcagtcatcttttgaaaacaaagttttgaattggctataggactcaacaaatctgcctggtgtaaatagaatctgttaagcttgatacatatctagatagatgaggaggggttgtattcattaagcatgagaatagagaaataggagtgcaaaatggcaaaatcttaacgtgggtgaaagagcttccttttactagtgaggtttaagtattaaagtaacaatagcctggtggcagatgaatgcaatttctataggatgggaatggaaaatgtatgctttggttaacaccattgctgttgacttcatgcagattctattaagcactctcatttcaggagccatttttcccacatagtatattagtatattttaagcttagctccctttatttttctaaagttgataaatcacctccctagcaaccttagttttaaaaaaaaaatcactaagatagaaaaagtattttcaggtacatagacatgtttgtcctcaggtttacctgcttctgtgaacagtcccagattttacaatgcagttttcaaataccatcaatcactacaatgacaatattactattttcttaacaggtttctaaacgatgtatgtgtgggatcacattaaaagtaagatcaccttataattatcttagaaactttgccccttgaagggagtccaaggaagacctacattttattgaattctgaatagcaaaagctctccgagtgagatttcattgtgtggatttgtggtttggagccaattacttgattttcttcagattttattctacttatttattggtactctgcttcatttcaaaaggatttgaggcagctactaaaatatatataatacaaaacaaaaattaagtgaggaactcagagcaaacaaaaatagaaacagaaaggataagacaaaactagacgtatatttagtacataaatgcagaaccctgacatgctttactaaatttgccaatgagtgacaccatgaaaaataatagaattagtggtaatgacaagaagaagtacttctgcatgataagaacaaatctttccccatgcaggtagaggtttgaaatagcatagatcattaaaatccacaggtaagcttcaaacctagattttgctagctacatgtgcctggcatatagtgtgtattcaagaaatacctgatgattgacagaatgaatgaattggaggaaaatgaaatatttattcaacaattacttgtggagtgcctattatgtactatggcagatattgatatcgtaagtcagataaaaatccagctcttaagaagtagaggaaatagagcttggtgtggtggcatgtgcctatgatcccagatagttgagagactgagggaggaggatcacttgagcccaggagttcaaggctgcagtgagctatgatcacaccactgtactccagcctgggtaacagaagaataccctgtctcttaaaaaggaaaatcaaataggggaaatgggatatataaataaagaacaatagtgaatgtgtcaggtgagatgacggacttgtaatgtgctgtggggggtcaaatatgaagaaggccttcttcctctggaaaggtcataaagaatgtcacacttgtgttggaacttgtgaagtgggtagaattttatcaagtagaaatgagagaaaggcatgccaagcaaaggatcggcatgaataaggtctactagtttgtggtcctctggctaagaatttgtgctgtgcctccattaagagaaagcaaggagctagtttgcctggagcacatgatttatgcatgacttatacatgcaacaataagaaataatgctaggaaggcaggtgagggatcactcacagagagacttgaatgtcacactgagctgactggctttcctcgggtgagagagtgggaaataattggggaactgacgaaagtgtgaatccaggaaggctgaactttaagaaagctgagacggtggcttccttacctatgcaaggaactaacaagccacatatacactccaaattgatttaacaaattaaagagaaaaatagctgtactttgagtcctgtgtctgcattcatcattaacctaagaaaatacagccatttaatacgtggacaagcaacacaatttaacagccactttaaagttttcaacaataggtttcaacaactaaacctaacaactttttatatctatctaatctaaacagtaaaatctcagctccaggttttactgagcttgagtgctacttttttttttttagacagagtctcattctgtcacccaggctggagtgcagtggcatgatcttggctcactgcaaccttcacctcccgggttcaagctattctcctgcctcagcctcccaagcagctgggattataggcgtgtgccagttctacttcttagtaacaaactagtagctaatcaaatgcctacataatggtcatgataaatctgtttaaataaatggcgggcggaagggagttgttgaatttaacaatccatccttcttcagaatctataggtcagccagaatataaatctagtaattattgaaaaacaaaacacaaactccttcaaagaaatctctctcctctattctgctgaaaagggttggtaaacctgacatcctttcttttattggaagacaaatccaacatttgttagacatccaacatttgttggaagtctaccttacaagaaaccacctcttatctgcaacataaacagaagctacatcaggttgaaaatccacatagaagactggagaaaattgccgtcccctttcgcactaggttttaccaggggcccaagatgtcagaggaaagtccgcggagggccaaacacaggtttacctaattatgaatctcagattagaatgtcttattgtgtggaaaagtcagaactcaggaaatgtgtctgaagccagagcgggggtctgcttacggagtctacgcagcgggtaggggtccactattggagtataaacctcaggtcagtgagtagtgcagaggtgtccctaacttccaatggagggaaagagaggagagcaaaggaaacacatccagaagtcgccacgagggctgtgtgccagcgctccattttcatgctgtttggaacaagacgtgtcaaggaagatgtttctatccaaagtcttcatggagcctctgcttcccctgtacctgtgtagctccctgaaactgaggacccacgtgtctgcaaagacctctggagatcctaagagagagaggcaccagcaggtaaccagtggtggcctggccacgaaagagtatttgaaattcaacagtgagcaagtgcagaaacagcatcccaaaccgcaggccccaccacacgcaggaaccagaaagctgaagtttcaccaaggagtttacttagtatttctcgctgggaatggggatgggtagcaaaaagcccctttcatgtacataatggttggtcctatgtcctacttttattttctctaagagttttagaagaaaggctgttttaatttttttttctccttaagagcaacttcctttttaaaatgctttcctcttcttgtcctgcttgagtaatgcaggcatcattctgaaatcattctgaaacagctaggcagtcgccttttgccaaaattacttctctaagaaaatagagtgttcttttttttaggacttagaacccacaaggggtgagtggaagttttgtagcccatcaaaggtgaatatgtgttctgcagtatcaactaaaacagtgtacaaaatcattaaactgggccgggcgcagtggctcatgcctgtaatcccagcactttgggaggccgaggcgggtggatcacctgaggccaggagttcaagaccagcctgaccaacatggagaaaccccatctctactaaaaatacaaaattagccaggtgtggtgttgcatgcctgtaatcccagctattagggaggctgaggcaggagaatcgcttgaacccgggaggcagaggttgcagtgagtcgagatcacaccattgcactccagcctgggcaataagagcaaaactccgtctcaaaaataataataataataatttaactgtgttctgcacacacagaattacaaaatccctataggactttcacagatagctttgggcttaaggtcttcggacaacaggtagttctaatttcttactctttgggacatttagtacatgttggtacacataaggaaagaaaatggcttatattagagctaggaaacaggggcagcctggatttttatggtaggaactcactctgtgcttttttttttttctgttaagttttcttgacactgacttcggtaacattggctaaagggaattgtgagtcatgtgaatttcacctgcagtgcagactttaaaggactgtgttcattctgatttggggatgaagagaatgttccatgcacatctattgattggtcttggcagttgctgatacgcttgtctcattcacactcccaaaggcgaggatttaccctagaaatcataaacccccactttccaaagcaaagatgctgttaatgttatgatggtgcataaatacctcaactgtctgggctgagagagggggctgcaggtttttaagagagcagctatagtcctcattccatgtagtcacatcatctgatgacaggactccacattctagcttttctcactgtggaaaagaaacgttactgtttaattaatatccaaagttataaatacagcttgtaaattttactaacttgtttctttttcgtttcgtccttgagaagtacaacttgcatttacagatggtaattcctagtgttgttctctgctatctttttttggtatgaaattgctgtatttgttaaagtttgttcgttttgtggtttttaattcccattggtgtgctgtacaatgtagtgtatcatgaagaaagaaataatatgcagatgtattatgaaatgtgttttattttcaaatgtgtggtgttgacaatatattgatttatcaagatactaagggaaaattctaaatttaacaaaatgtgtatattttaataaatgcataaagctttattgtgtgcctttaaatttaaaaatgggtttataaagaaagtcagaaacaaaagtgtcttactataaaatatccatagtaatgtaaagcttttacacgagactaccaaaaaaaaagaaagaaaagaaaaaggagccttcccatattttgttaaccttaaccagtatctgaagtctgttactttttttccattcttaaatggagatgaataagtgaatttcgccttaagtgtttcaattgtcctttgtagaaaagccagataaatgagttcactttgaattgcattattgtggaaaattcattttcagaataaaacattttaaaaagta

SEQ ID NO: 19717 - DNA, 473 bp, Homo sapiens
  ENST00000466168
ttcctttgccgccaccaccacttcccatcccagctagagagacagctccgcgcagtaagtgcggactgccagccaccagccttggcagccagctcgtcgcctccagccccgaccccgacagggtctcactctgttgccgaggctagagtacggcggtgcaattatggcttactgcaaccttgacctagcagggctcaactgatcctcccacctcagcctccggactagctggaactacaggcatgcgccaccacacctggctaatttttgtattttttttgtagagacagggttttgccatgttgcccaggctgatctcaaactcctaggctcaagcagtcatctgccttggcctcccaaagtgctggcatgaaccactgtgtctggcctactatttggacttttaaggtgattttctcctctttaggcaaggaacatcaagcctttcctagcataagaccaaaaacaaacca

SEQ ID NO: 19718 - DNA, 2236 bp, Homo sapiens
  ENST00000374299
aagccgcagctttgaagcctgagcggccgaactcggcagctccaacccaactcggcttaactccgcctcaccgagcccagtccaagactctgtgctccctaggtttgcaacagctctctgatcatcttcttcaattcctgctaggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgtcctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtagaaaaat

SEQ ID NO: 19719 - DNA, 2235 bp, Homo sapiens
  ENST00000298085
ataaggggcgcttggcgcgcaacgaccccaagccgcagctttgaagcctgagcggccgaactcggcagctccaacccaactcggcttaactccgcctcaccgagcccagtccaagactctgtgctccctaggtttgcaacagctctctggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgtcctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtag

SEQ ID NO: 19720 - DNA, 3983 bp, Homo sapiens
  ENST00000565644
gtcctttcacgcgtgtcttcgtgttggtgcgcttttcactggtcataaagtgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 19721 - DNA, 4537 bp, Homo sapiens
  ENST00000261622
gcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 19722 - DNA, 780 bp, Homo sapiens
  ENST00000563489
gaccttgcatgttgctcagatgaggtttctcctttaaaacaaaattccctggtgctcagctgggcccagccaggctggacagtccccggtggccaccacggccgtccacagccctgctcgtgggccccagggctcagccagccgcctctctcttccagtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttgg

SEQ ID NO: 19723 - DNA, 20987 bp, Homo sapiens
  ENST00000406785
ggcgctgcacggtagtcagcccgccgccgccgcctgctttgtgcttcccacagaagatgggagcgacctcttcctgatcgggagctgtttaaaaggagggagtgcgccgtattttctactagcgtggaggaacggaggaagaatccattcacactccccaaaccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctgttcctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcaggaaggccaaggagaaaggccttatagagacgttgatatgttggatgtgcctaggctttcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgttgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccgacttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatccttattttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttggggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatggtattattgtgcaactggtatcatcatccaaagaaaaaaacagacaccaagtattcaaactcttgcaaacgtcaacccttcggtcatgcaatgttctctttttaatgtcccaggagaacacagtgtcagaatatttgtctgtcctacagtgctgagatatatgttggacattcctccatttcactgattttttttacgttgcttagtatgactctatctacatcctttcctgcatccaggatcataagcccataaacagttacatgtcagacaactttttagcatgcagagtattacatcaaatcagtcgatcccaaaaaattccaatcccaaaattgatggtagtacagtttcttcccaaggggatgtttaagtaaatttctcttttagtttcatatgttatattcctcttgtagaacttctgcctcgcattaacgatttctgtctatatcttattaacttcatatatcatatagtcaaaacagtatagaaggaagtgatgtcagaaatggaataagcatttgtggggaaaaaatgtgacctctaaggtttgtgtacttatttgaagttgacatattagtggacttagttcttactataatagaatctgtccacatgtacaagtaaatgctactttattgatccgatcatctttaaaattttctttagtattcctcattatattctttatatggtcatatgtggtatactttcatgtatgaatgaaggaattatttaaatattttatagtatcaaactgtcaatatgtctcttgagtaccagcctttggtttaacacaaaatgagcagccaacctctatttctttatatagcaaaaagattaattcaatgaccagagctccttgaccgtctaacaacctttcagaaaaattctgtgacctgataattatcagtttcttacaagcaaattttaatgggttcaaatttcctgattccatccttcaaccagtgagtgttttataaaattttgctttttgtagttcatagcctaatagcactaattttttgttgcttttcaaacataaaatttttacaaaatattgttttagaaaccctgcaaaaattctgatgcatgcctttcccctgtggcctcactattaatgaaagctcaccactcacattgcattttccacaggggtcttgattcattggtgattccacagcaaaaggtccctgatcctaaactgtcaaaataaagtagcgagactgatatacatctgataactttgtggaagcaattagaaaattttctctggtagatgatgatgccctccatcctctaatagtggcagaactttgccttctcaagagaataaatcagcccctttaagacttcttttaatatttttgggctggggatatggagtctctctgttgattctgactttctgactatgattttgggcagttgcatgcagagcaagttctgagtgtagtttcataatctcaagaacgtttggccattttatgattgacagcatgtaatattggatctcacctgacctacaactggcattcagcttttatcattgtaatcacttcacttggccaaggcagttggtaaaactgagcaaagttaaatataaattccaatcattaaattggtgagtgcattatgcagaagatacagaatcctatttcagaaaaagaaacatgctattataagtggattccttagattttgttcagctctacctacggagttttgctaatagaatgtagttctgctattcttttttaccattatgtactcaccacttctaaccatcttgttgtcttcccatcacgcagtacatttcaaaatgctgggcggtcccgatggtattacacccacaaggacagcataggaagggtaaacaattgaaatagatatttcatgttgggagcttaattaggccatgattaatcgtctctcaaagcagagactgtcttatctataaaaggagcaaccactgagaggtggaactcccaaaggaaagcactgcaggtttccagcccacaagaaatggtacgtatttcactttctttgactttttccctgcctgtcaagatgtccaaatgtactcagaggctgtccacattttcagttttgtcaaaggttctctgattcaattttgtaagaaacatttaaatcagtggttatgtaaattattgtttattttgttttacttttaggaaagagcattactgtataacttcaaaaagcaatatgacttagtagttaaaattatgacccatattttttcaggaagacttgcttgcccaaaattgtcttgtctatctgttatcaatgtagtcattcatagctgcctcagtggttcacattttttagaattatgcttccctagcattttttcaaagagttggagagttttccccatgggaataaacagtcttaatatttcctttccctaatttcagcctttgcagttcttcggtgactactcccattatatccaactacccttagtgatgctcactattacctcccggcaatagggaaagagcttatgctataaagtgattgctcaagacatgtttttctgaaagtgaacttatcataggagaaatcaaatataatgacattccacctagataagagtcactaggacatagtatggaatctttgtaaatgagcgggacagatcatacctacagttacacatataatagtgttgtttattttatacctcttgaatcatatttattatgcttcagtgctgcccatcgacctagccttttattctatcaatatgtaggtgtggattgggaatgagaaccgacattcacatccctgatgctcatgagggtttctacaaaggtggagtatgtaaacatagaaaaacgtaacagatagcttccatgcctctaagaaatatgagtgggtcaaatgcttctctgtgggtactatttttctgctatgcaaatggtagaaaagttcacattaatagccaaacagaccaagagagaaattagctaacttcactgttaatctgtctactttgacagttaagatatagcccagccctcctaatttgttgactgcaaagacagatacgcctagttaaatccaagaatgcactgggggacggggggataaagttactagaataattatacaaccctccgtactaagattgcttattcgccaagaagaatcctgcccagagattttcagagacatttccttacattcccaaccttcttttaatttacacaactttttaattagaccccttgaagccacatagtaaaacaagagatgaattatctaaggagaacttttggccctccctctaatgtgaagatcacatacttgactgtatttcccattctttccaaatggaaagaacagtccaattaagtaaccaactatgtaaccactttttgacgtaattccacctaaaaaacaaagagtgaactaaattgtacaaacattaaacctaacagtgatatgaccagatggctagttttgagaaaaataatattttctgtagataccttgctctcccttcctgtactcatcctaatgctcaagtttgagaaatactccaaggaagaaatcttgaaagattgtacattcaaataatgctcatgtaattgagtaatatggcatttgggatgagaataagagcgtatttaaaaataagagaattggcacaaaaatgtgttaactaggattttattacaaattgccctaagatatttgcaagttattatatttaagtgaaataaatcccagtttccagaaacaacagtacaatttatattcgcaggttttatatgaaaatcaaagttgggcatacatactttttggctttggcaaccaaagaaaagcatgtttttggcacacgtttccaaattattgagttatttgtagaatacattggacctgtacaggtatctcattaaaattaccttcaataatttccctttcttcctttaagccatcaagtttctaaattttacaacttcacagtttagcaatttcatttatgaaaggctgattccattttgatgttgatttttacatttcagaatttttcatatataaatatttgatgcattagatgggatactgagcttgagtctggcccaaatgaaccacaaggcccagactgatctatcagtagttagaaggcttctaatacactggctttctaatgtacagtaaatactagcgttgttttcaatattctttcttttgactaaaagtttccattccaactggtgaaaaatttttaaaaaatatttataatgatagttagagaactgtttatatgaggatcagacattgtttcagcactggatctcctctgtcccctctcttgctacagcatacagcccagagacacacatgtaaaagtaggtgatctctgtaaacttcagctgcatttctgtatgtctaggattgtcctagtatcagatatcctttgagaaagagttggagaggcatggaaggaagcatattcctgacctcccccctttttagctaaagatacaaattcagagctgtttgaaaagggcttagaataatattaattaaacatattctataatacaaagagaagtacttttttaaaatacatttatttttctttcttttttagcaggcatttctgacagaaaatctttagggccaattagagtttctttctgacttttaattgccctctgccttttgggaaagtgttgaaaaaagctctggaaaaaaatatgctggtcaaggtcgaaccctggggaattaaaaacatgagatttttatattttccctccaaacatagcactgagcaggcaggttcccatgcctgttgttaatcggcattttcttttttttttttttttttttgagacggagtctcgctctgtcgcccaggctggagtgcagtggcgggatctcggctcactgcaagctccacctcccgggttcacgaatcggcattttctaaacacgtgttttggtgtgctgggagcagaggagtaggaggcccacccagtcccaccacacataccgggacatctttgaccacatgggtcctctgccgttcgtattttagcttagatgttcttaactgaactaacttccaattttcatatacactgatcatcttgtccctagcattttccctccaagatcctgctaacaggcaaactagccctttcaaacagttggtacctgagatttctcagagctctcttatcaagagtaaggagtgagattgcagaaggggcagtaatgtcaataccaagttattggaaactacttaaccagccactgcattacatactggagcccgtctaggacacttgcccttggaaatggtggaaagactttgttttatttctatttcatcaacagaacttttgtagcattgaatctaagcaaaggataacatcatattataatggaaagttatttttaactacaactgttattgttaaatttagaagaaaatattgtctttgaagtttcagtccaaaactctaaggagaacaaggtttttactgccatcggtaatcctgtgagaaatttgacactccagatcttatttgagacagataagtctatgataaatatatgtatgagacttaaaatattcttgatattctcaggttgttctcacaaattctgcatagatttagttgtttttttttttatgagaacctttcttatcaaaaaggattgaaaatttttccaacaactggttgttaaatgagtctagcacccaaagaagctgtgagcagttggttctaccagtgactcttctaggagctctttccaggttggtctcgaactcctgacctcaggtgatccgcctgccctggcttcccaaagtgctggtattacaggcatgagccactttgcccagcctgatagttctgactcaatccctagacacattcttcagaaacaactgtacatggtgagagaaaagtgaaaaggaaaaaagttttccttccttcaaaatacactaaatttgcttatcacctttaaaatttggactgaatgtttaaactttaaacacaaagcaaagggagatgctcttaaatgtgaaatctgaagcaaagattgcatttttgcaaagctatccagaagatgtgttaattattgagacatgggattcattaacacatcagcgcccaaccactgcctctcctgcccccattcacacattatccacaatcaaataagcagctaagcaggggaaacctatcactgttaatgtcataatcacatcaccactgaattaccagatgtggtcaggaactaggcaaagtaggtgggaccaatcctaggactggggccataccacaacctcagctcagccccttgtcggatacggtttctgaatttagtacaatgccagaagtattttttttctttcagctgtgaaccagcctgttttgtttgacaagcctttccagattcatgcagctcaatcacgtgcttgttgccagtttgagagtgaacctattatttcaaacttgttgccgtgaccaatttttacaaaactgaaagtagcactgtgaggtggattggacctagtgatgaggtgtctacacttgcatccttttcttccaagagaatattctgacactccaactctagaagtcatgtcattagtaaaatgaaaataataattgcttaatcactgtttagaattagttcatacttcttcagagcttgaagcctccacgactcaacatcagatccatggatagtattactatacctttacccaaagactggatttattttgtaaaaatatcagaatgggtctgggtccctttaaagcaactgacaaggtatttaacaacattttaaaacaatgaagaaaggatgattctgcagaggctgctgggttacagaggagggcagagcttttgtcagactctcttgatgttttgctcttcctggtaagtttttatctatcatggttcccagtggaatattctccatacacattctgtgggaggatattgacatggctctagactctgccttttattttctaattctccttggagaattagaacaggcattccagaacttgtaatatagaggggaagaaagaaaaaatggcagatgcctcattgatggatccacaagttttgtacaaaagcacacaccattctgattgtctctatattaacattgtactcaccaaacagctttctaaaggtgactggaacaagataaatatcaactggataattacctaaggaaaaagaataaaaaagaaatcaaaccaaaaaaaaagcaaaaaattggtcagtttagcaagcgtgttttccaggatcataggctcataaactatacagtcaagagagtgaaacaattttaaaatcaaaagttagagccttttatatttcttcagatgtacaatttcataaatcaagcatttattttgtgcaaagtattatattaggtaccctaaatggtatataaagaattcaaaacagagtaatttaagaaaattaacactagtctttgatttagtcaggaagagtccacttatggcattctaattaaattaaccttccattttggtctacattttatcaatttgagattgcttaatggggccattttgaaacctatcaagaaactttcctctaacagaaatagaaatattaattttcttaatttcacattctgtcttccactaataagataaatggattcagacccaacacacacatccagagattaccatgagccaagacctgtgtaagtttgatatagggtcttttattcaacatttcaagttgggaaaatcttattacaaagatcatttgcctcaccattgctgaattcttttactaggtgttgatgctaattcatcactggattttcttaactctgcctgttgctcttttggactttgaggcatgtggttctatttcagtgagttacaactccagctctcatcttttaacagcaaactagagaacatctcactcttcatctctgaggacacagtgttctcttcattttaacatcaaaaagtcaccagagagaagacccaaaggcttttctctttggaaaaggaatctttaattgtttcagagggtgaggaatcttcagctctctctggacttgattgtcctcatcattaaatgggaagactttacctttagcttgattttccagaacacatcaagccccgtatggtcagtgtttccctgttatcatccacttatgtgtatgggttgaaggtactttaagttgtgagccagctgctgcccatattgggtcaccaatgcacttgtcaagcccatgtaaccacatgaagtttgatagaaatataaacatttattttgaaataattccatgtgcacggttggaaaaacagtctcccttccctgagaggaatgagtaatttctcccttttcaagaagtgtacagtagaaaatgtaatgagattggaatggattccaaatcagtgacctttttaaggctgaaaccactattttaaatgaaaactttaagttcatacagtttcttatagtaattctacttttattttttagtcagtgtgcttaatcttttaggaaaaaaaactaaccagttattttttactaaagtatgtgaattacaaacaggatgtgcaatgaccaggcagaaagatatttaaaggtgtaattattctaaaggaagatgagaaaaaattcatctgctacagattcaactgtcttttaaatgcctcccttgtcatggagtaaatgactactcaaaaggatttcacaaaagacttaaatctcacccttagcaatcaaccggtcggccacagctcagatgcctcattagcaaaatgaaattgcacaacagacgaaacatagcaaaagaatgtagacatttccatggggtggaagaaaagaagaaagaaaaagcaaccatagtgaactctgcttgcataaacaaagaatgttttagtggaataaatgtaagctttctcttgaaggaatcccagttagaatgtcattggaaacggcaaaactatttcagcttcatagcagtaatatattccaactttattaccactgaggcacaaagctaaatttgtcagggggaaaggtaagcaaaaattactgacattgcaaccgataaaatgatcttgtgagactcaatattgagaaagaaaattaaaatagctaatatttctgttataattccagtgattactaagacttctgccaagggataaaattacttttccttctctcattataaatttctatatagagctattttaatgcagtaaggactgtattttcatattttaataaatccctcacgttgaatttgccccccatttcagatttgattaggaaatactaaattgagaaggcaggtttttccatctttttaaaaacaagtatgcaccataagcattttcagcggatgtctgccttaagcaatcttggtagagctgtcaatcagtggcaggtgcttgtttaaggaagagaacctgtgaatagatttagcctttcttcctcacagacagctgctcattcacacacgctcatctcgtcttcctcaacttcttgcaccaatcccgcctcttggattgacccacatccacctagcagttgaacaaactgcagattctaattacatgtcccgacagttgctcaacttaatttttcaccaactgaatttcatgcattgccccttgatgttccttccctctgttcactcttttctataagtccttgcatttgatatactttaaaatggatttgactaggaaaaaaaaaaaaaccaagtcagcaaacccttgtgttcattcaagaaattgtgaacaaatttagctgttatggtaataatcctgaggtgagagagaaaatatcacctaggtgacaagagatcattttaacgctattactaaaatagtattctatgaatagaggccatagaattttctacaaatagacttgtagggactcacattttgaatcatattttacttataggtttgctgtatatactgattaaacttctgaacctaaagattctctataattaaactagcacaaatataatctgtcccttacccacattgtaagaatgtctggtgggggaaatccaatattgaccttcacattccacatggaaaatctttgtccccagagtgcaattagggtgattaaaaataagccgcttttgtgagtctcaagtttgttccccaaacaagcagcatcagcaactggaaatttgttagacatgcaaattatccagtcccacctgagacttcagcccagatctatgaatcaaaaattttggagtgaccctggcaatatggactttaataagcccctaggatggttctgatgcatgctcaaatttgagaatcattgatctatgacacagcattctgagtggccaagaatgaacaatgtcacccactgcttaattatgctttcccttaagaaaaggtttaaatgcttaaaaggtaggttctttataaagataatgcattcagatatatgggagatatgtccaccattcagacttaaaatataattttaagggacattaatccttatgtctttttctggcataactgagtctgaggcagcctctccagtcagagatttctaatcagcttatctagttcttttaaaaccccacagctgatctactttgcctgacttccccggggcctagaaaatgaccctggacacctttctctaactgattagctctggctgatttgtcttaatgctaaaccactgtgtaacagtactaaattatacttaatgacacagtctactgttttgaagagtgctgtgtatgactgactgagctaaaaggattgctggctatgagtgagttttagttttagaattcattttcaaagactcacaaggctcaagaagcttgaaaaccacagatgatgtatacagtagctggagttccctggaggctcctttctagggtctctcatttgaattggtgcagaactgaaagcagagagtcagaaagtaactctgcttgtaaaaatggcttaggaaaaggaacttaagattgtgggttatatgtgtgtatgtgtgcacacacatgtatgtttcctgaattctaacctgaaaatatcacatttgtggatacttaaaatactcatatgcattttgatacacaaaagcaattcaaagtatgtaaaaggaggctggaaatgtaagcttaacagtgatattctggagaaaaatgttgtaactgtcactccaggcctcccttaggagaaaccaaacttgtcagatattttggaatggtagctctttttcaggaattagaataactgaagtatgatactgtgttccgtgtgctttaaaatctgtgaccctcccctgttgctggtcatagcttcagcatttgagtgtccattgtctgtcgctgaggacattttctcatcggctcttttccccattgtcccattcctctcactcacacctgattaccaaatagctctaacgaaatcacagtcactccttcctgtgtttccaccattgtgtacatcttcatttgcacaccctattttttaatcaaagttaaagcctcaccaacaaggtacttagaacaatcacccacttctggccacttcgtgacgggaaatacatctttgcaggggaaggagctggatcagactgacagggtttcactcagactatttcaaacaatgaggagccttgacctcattcccaacttttgccgtccatagtggttgatttcttgttttctctttctctctttttttaacagaaactcttaagctcaaggctaaattacagtggggacttgcctttgtctacagtccatggtttctgtattggctcaagccttgaaatcttgaaacaagcctaaattaaaattttctcttagcttaagaaaaaaagttacatattgtcaagacccttatgtgtgtggtccattaaaaaggtcttgatattagaagataacagcaaattgtttcttatcccacaacagctttgcctttcagtgtcctttgtggtggttttcgtaggtcagtggtacaattcaacactcttccaataagccataataataattgttggcacaactgttattacaacaggacttgcctgggttccatctattaatttttacagacagtaggaagctcacaccgaggagacattggtaacttcctggacaagggcaaagaaaggaactagcatattgtacatactgtgtacgtgcacagaacactggtctgtgcctttggagtgttctcagaggggcaggccagaagggaggattcaggtaggaaatgaatctaggacttctcttgcctttgatggttactgatggcaattgtgtttcccactgaataacttggtggacaattttgatagtaaactgaactcataccgagcaagcacaatagtcaatccataaagaaaagggtggcatatcataatgccagaaaccttgtctccctaagaggtgatcatgaatttcctatacagggcaaaaaagggaagaatagcctattcatattctgtattcacagtttgaaggacccatcacaaatgaccttcaaagactgacagggggcaggtagaagggaggcaaaaatgcagagaaaaagatgttaccttgaaaaatgaagtaagaaatcctaatattcccgtagttgatcctaaagtttgttcccatgtctacggttatttctaaataacttcactacactttgaaattccttagtggtggtttatcagtaatacttaactgaatttttccgtttctattctttgctgccaatgaatgtaatctccacgacttgccgttcgagtgcacgcacagacacacacacataatggtatatgcatcatatattactcattttgtgggaaacacaatgtattataatgaaaaagattccagcacattctttcagtgtgtttcagtgataaaattttgtgggggaatagaggtatacatactctctttgctgaccatattgttgaaattatgatcttaagcaacactgttagaaatgcttgcataaagtatcttctctagtattaatgagttgattcactctgaattgaaggttcaaaaaaatgcactaaacaaatatttttatatctgtggtattttcctattaactactcttagtgaacacgtgaccatatacctgatatcattaaaaaggaaaatggcctaaacgaaacgttaaaagtggaggtatttataaagtcttctgccaaagaccattgtttaatgatctgtaaaatgtagattatcttcttttattatgaatgtgattgtaagaaacaccctaacattctctaacttttgaaaatgaatattttgtatttctaaggaccaaggaaaatattttttaagccaatgtagtacacagaagccttgtaaatgagaggtacaatgacttggatcaactgcataatgctagattagaattccagcatttgatgataaatttatcaatctttcctataattcttatactgcactaaattacattttggaaattttagctaatcttttcaaattaaaggcaccaacattaatgacagatcttctctaatatgaaaagcatcaaaacattccctttcaagcactttgaatggatgaaaattgccatataattttcccacctacctaaccattccatgtaagttaactgagcagtctaacaatgttgtacagaaggttgacagactatgtgcaccaagaatatttaagttgtgcagttagcaagaactagccatttcaaatatactcaaatgttttgtaaataaaaattttgactcctataattttgttcaaactgatgtcttttaaaataattagattttatttgaattttaaaagtaatctgttgtaaattagatgttactttgttgactctgtgattcaatgtacactcagccatattcctgtggggaaatatcaatcttactgactttcatggcatgagccagagattcatagtttcctttaggactataagtatgaagacaaaacacaccaaaataaaatgctagtgaagaaattagaaacctattgtataaaatgtatttttaaaatcttaagatatatgtgatttacactgcctgttaatctagtctctttgtgattaaaaaaaaacataatatttgttaagactcagacaccaaatatttgtgatgtttgtatagcaccatcgttatatgtgatttcaaagggtaagcatctctgtcgtaatcatgtaagcccacagaagaataaattcctgaggttatgtacaaccaactctcagaattcagacttcctgcagctgccatatcaccaataaatgagaattgtgaaaaacaatttttaaagaattgagtttatgatcactgtgcattttgttaatgaatgatttcagagttttatttttaccagaaatgctctcagccagtaaacacaactgctgatttcaaccatactatcatttcaatggtttctatattcttgatctaactaccaaaaactggaagcttgttgcaaggtgtgtcctaacaaacatacaataaatgactcttcctgcatgctgcctgagatatgttgtaatttgaaatgtcttatcaaaaaattatacatgttataacccaaagttgaactggcaatatttttcatgtgtaaaattgatggtatgttaatatcaaaagcagaagcattgtttgtcatacatgtatgttatatgtgatgtttaatcgtgttaaactgtaatctgtgaagttttcattgcctgaactagtcaattctgtataaatcattgtcttaattgttttcctaatcttaccatatttcctaacactgaaatataaatgtttgtcaattagcca

SEQ ID NO: 19724 - DNA, 3434 bp, Homo sapiens
  ENST00000407929
atgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaaggaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaa

SEQ ID NO: 19725 - DNA, 3178 bp, Homo sapiens
  ENST00000403092
aagcttgacagaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgca

SEQ ID NO: 19726 - DNA, 3139 bp, Homo sapiens
  ENST00000405901
taggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggca

SEQ ID NO: 19727 - DNA, 3065 bp, Homo sapiens
  ENST00000402441
ctttctggtaaatttagagaaggcatcatactgggatcttttttcacatccagcccatgcggactgagcagccaaagcttgacagagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactag

SEQ ID NO: 19728 - DNA, 2965 bp, Homo sapiens
  ENST00000405269
tcttggttgctctcaccatgtgatacaccagctccacctttgccttctgctgtgactgtaagtttcctgaggcctctccagaagcagattctagcaccatgctgctcgcacagccttcaaaacttaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaagg

SEQ ID NO: 19729 - DNA, 2898 bp, Homo sapiens
  ENST00000408028
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 19730 - DNA, 563 bp, Homo sapiens
  ENST00000455476
atcagtcgtggtgactgccctggttgcactgtaagtatggggggacgtctccacgaaaaaaaactaactttctgccttgtgctctgcaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 19731 - DNA, 561 bp, Homo sapiens
  ENST00000448531
ctttctggtaaatttagagaaggcatcatactgggatcttttttcacatccagcccatgcggactgagcagccaaagcttgacagaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 19732 - DNA, 583 bp, Homo sapiens
  ENST00000417271
agcgacctcttcctgatcgggagctgtttaaaaggagggagtgcgccgtattttctactagcgtggaggaacggaggaagaatccattcacactccccaaaccagggatgtcatggtctagaacacctatgctgaagtacaaggctgagcaagaaagatcactccactgcaactgagcaaagtgctgaaggagttgaaaggaagaagagaacattggacgtggtttcacggaggaggaagcattttaatttattcagaaagagtgaaaaggattttgaaagcaaataaggctagccacttttgaaacatgtcaaagagccccagcttatttacgacaagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggaca

SEQ ID NO: 19733 - DNA, 2922 bp, Homo sapiens
  ENST00000332839
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 19734 - DNA, 2814 bp, Homo sapiens
  ENST00000406391
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 19735 - DNA, 137 bp, Homo sapiens
  ENST00000599740
gttttccagcactttgggaggctgaggcgtgtggatcacctgaggtcaggagttcgagactagcctggccaacgcaagggcagtgactggaagctgggagagagggtcaacagctgaatctcagcctgatggaggcc

SEQ ID NO: 19736 - DNA, 621 bp, Homo sapiens
  ENST00000628471
tgctggattttctggaaaactttttgcttttcttctaaaaggaacagatgtcaggaaacccagtgttgcatcacctgcttcttttctgtcttgagtgcaggtatgaagccttatgcagtggtagccatcttgcaaccatgaggcacttgactaagcaaaaagaaaaaaaaagaaaaaaaaatccaacaaggtcttgctctgtggcccaggctggtgtgcagtagcaagattacagctgactgcagccttgacctcccaggctcaagtgatcctcccatctcagcacccccttcacgctaccctgagtagttggactacagggaaagtaagcttattgcagcaagttgtgttggtgccacaagatgccacccttcccttgaaaagaagagactaaaggtaattatccagttgatatttatcttgttccagtcacctttagaaagctgtttggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctc

SEQ ID NO: 19737 - DNA, 623 bp, Homo sapiens
  ENST00000631142
gcagataatgcgcgtctgccatactcgggggcatgatttcagtatgaagaaaaaatgccgacctttgtcttgtatgtctgacaagaagaaaaaaatgccactcccctccaagctggatgttctgtgaagccaaagatttacagtctaatgaaacctccaccacagttattacggtgtcagaattcttgcctttgtttgggaaagtaagcttattgcagcaagttgtgttggtgccacaagatgccacccttcccttgaaaagaagagactaaaggtcttgtagcttgttctactcatctagagcttgtgtacatctgctaagtcacctggggattgctctcggaaaccatttaagcaacagacatgaaggtgtttggtcataaacaacacattctacaagagtaattatccagttgatatttatcttgttccagtcacctttagaaagctgtttggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaat

SEQ ID NO: 19738 - DNA, 225 bp, Homo sapiens
  ENST00000627210
gtgctcactctgaccttcctccctacaaagttgtgtgcttctccttttccttatgccatgattgttaagtttcctgaggcctccccagcaatgcagaactggagcgttccacttggctgggagcagataatgtgtgcatcccgagagcagacagaaccaagagcaggcaaacttagaagacactcagctaagcacttgctgacttcttacaggttcaccgatcag

SEQ ID NO: 19739 - DNA, 200 bp, Homo sapiens
  ENST00000631330
ctcactctgaccttcctccctacaaagttgtgtgcttctccttttccttatgccatgattgttaagtttcctgaggcctccccagcaatgcagaactgtaattatccagttgatatttatcttgttccagtcacctttagaaagctgtttggcaagggcagtgactggaagctgggagagagggtcaacagctgaatctc

SEQ ID NO: 19740 - DNA, 212 bp, Homo sapiens
  ENST00000627538
gccatgattgttaagtttcctgaggcctccccagcaatgcagaactaagtttacgaagacaaaagaggaatgacgactcagcatattggagcgttccacttggctgggagcagataatgtgtgcatcccgagagcagacagaaccaagagcaggcaaacttagaagacactcagctaagcacttgctgacttcttacaggttcaccgatcag

SEQ ID NO: 19741 - DNA, 327 bp, Homo sapiens
  ENST00000630783
actcaatatcatgtttactgtgggtttgtcatatacagcctttgttatgttgagaagtttacgaagacaaaagaggaatgacgactcagcatattgtaatgtatattcaatatgtgctttgctaaatatatttgaaaagtatataggtatattgaaaaagaccatgtccaactgaaaatgcccagctaatgaaaataacatttttcttcctactgaaaactaaggtaattatccagttgatatttatcttgttccagtcacctttagaaagctgtttggcaagggcagtgactggaagctgggagagagggtcaacagctgaatctc

SEQ ID NO: 19742 - DNA, 233 bp, Homo sapiens
  ENST00000626098
gtttactgtgggtttgtcatatacagcctttgttatgttgagaagtttacgaagacaaaagaggaatgacgactcagcatattgtaattatccagttgatatttatcttgttccagtcacctttagaaagctgtttgctctcaaatctccaggcagcctctattgattgatctgagttggcagatgagttggcaggcaagggcagtgactggaagctgggagagagggtcaac

SEQ ID NO: 19743 - DNA, 181 bp, Homo sapiens
  ENST00000630006
actgtgggtttgtcatatacagcctttgttatgttgagaagtttacgaagacaaaagaggaatgacgactcagcatattgtaattatccagttgatatttatcttgttccagtcacctttagaaagctgtttggcaagggcagtgactggaagctgggagagagggtcaacagctgaatct

SEQ ID NO: 19744 - DNA, 545 bp, Homo sapiens
  ENST00000418854
agtcctcatctgcagtgatgacagtagtaggtggaacatgcctgtccttgggcaacagggcagtgcacgtgccagcaccaagtggttccagaagtttacgaagacaaaagaggaatgacgactcagcatattgtaattatccagttgatatttatcttgttccagtcacctttagaaagctgtttggtgagtacaatgttaatatagagacaatcagaatggtgtgtgcttttgtacaaaacttgtggatccatcaatgaggcatctgccattttttctttcttcccctctatattacaagttctggaatgcctgttctaattctccaaggagaattagaaaataaaaggcagagtctagagccatgtcaatatcctcccacagaatgtgtatggagaatattccactgggaaccatgatagataaaaacttaccaggaagagcaaaacatcaagagagtctgacaaaagctctgccctcctctgtaacccagcagcctctgcagaatcatcctttcttcattgttttaaaatgttgttaaatac

SEQ ID NO: 19745 - DNA, 565 bp, Homo sapiens
  ENST00000439606
ctttggagtcttgctcttgctgccaggctggagtgcagtggcgggatctcggctcactgcaacctccaccttgtgggttcaagcaattctcctgcctcagcctcccgagtagctgggattacagggagcgttccacttggctgggagcagataatgtgtgcatcccgagagcagacagaaccaagagcaggcaaacttagaagacactcagctaagcacttgctgacttcttacaggttcaccgatcaggtaattatccagttgatatttatcttgttccagtcacctttagaaagctgtttgaatgtgtatggagaatattccactgggaaccatgatagataaaaacttaccaggaagagcaaaacatcaagagagtctgacaaaagctctgccctcctctgtaacccagcagcctctgcagaatcatcctttcttcattgttttaaaatgttgttaaataccttgtcagttgctttaaagggacccagacccattctgatatttttacaaaataaatccagtctttgggtaaaggtatagtaatactatccatggatctgat

SEQ ID NO: 19746 - DNA, 342 bp, Homo sapiens
  ENST00000629157
atgaaagtctatatcctactttgacttcactctggggttgcttgctggctgaaaggaaggagaatcaaatttagaaatatctgaaaggaaatccagatataggctattaatagatgagaggtgaagctaggctatatcagctgctgagttctgcaccaattcaaatgagagaccctagaaaggagcctccagggaactccagctactgtatacatcatctgtggttttcaagcttcttgagccttgtaattatccagttgatatttatcttgttccagtcacctttagaaagctgtttggcaagggcagtgactggaagctgggagagagggtcaacagctg

SEQ ID NO: 19747 - DNA, 637 bp, Homo sapiens
  ENST00000599268
gacttcactctggggttgcttgctggctgaaaggaaggagaatcaaatttagaaatatctgaaaggaaatccagatataggctattaatagatgagaggtgaagctaggctatatcagctgctgaggtactaccaattatacttagattaaggagaggattttaaataagagcatgaacctaaggccatgagagtgggaggaatagtgagctttcaaaacttctaattttcagaggcaagacctcaaccatggcttatgtatataacaaaggtgattttacataataagagaaatgaaaatttattttcaggaaagtttaggaaactaagaaaaaaataaggttaattgtgtttgagggactatcttaaagtttcaatagtgccataagaggaaaaaaatagaagaatatagaataatgaaattgtgaagactctctggcttaggaggcatccatcgtttactgctgcccaaacttctctaccaggcatttaaaatcttccattcgcaggtaattatccagttgatatttatcttgttccagtcacctttagaaagctgtttggcaagggcagtgactggaagctgggagagagggtcaacagctgaatctcagcctgatggaggccaccatttaat

SEQ ID NO: 19748 - DNA, 472 bp, Homo sapiens
  ENST00000597385
actctggggttgcttgctggctgaaaggaaggagaatcaaatttagaaatatctgaaaggaaatccagatataggctattaatagatgagaggtgaagctaggctatatcagctgctgaggtaattatccagttgatatttatcttgttccagtcacctttagaaagctgtttgtaattaatcaaactcaataacagcacaaaagtaacaactcaggtgaaaagaaaactcacttatgtcttcaatgtccaatcaacattgccaaatgggagaacagttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccaccatttaat

SEQ ID NO: 19749 - DNA, 700 bp, Homo sapiens
  ENST00000625234
ggggttgcttgctggctgaaaggaaggagaatcaaatttagaaatatctgaaaggaaatccagatataggctattaatagatgagaggtgaagctaggctatatcagctgctgaggtactaccaattatacttagattaaggagaggattttaaataagagcatgaacctaaggccatgagagtgggaggaatagtgagctttcaaaacttctaattttcagaggcaagacctcaaccatggcttatgtatataacaaaggtgattttacataataagagaaatgaaaatttattttcaggaaagtttaggaaactaagaaaaaaataaggttaattgtgtttgagggactatcttaaagtttcaatagtgccataagaggaaaaaaatagaagaatatagaataatgaaattgtgaagactctctggcttaggaggcatccatcgtttactgctgcccaaacttctctaccaggcatttaaaatcttccattcgcaggtaattatccagttgatatttatcttgttccagtcacctttagaaagctgtttgtaattaatcaaactcaataacagcacaaaagtaacaactcaggtgaaaagaaaactcacttatgtcttcaatgtccaatcaacattgccaaatgggagaacagcaagggcagtgactggaagctgggagagagggtcaacagctgaat

SEQ ID NO: 19750 - DNA, 340 bp, Homo sapiens
  ENST00000631204
ggggttgcttgctggctgaaaggaaggagaatcaaatttagaaatatctgaaaggaaatccagatataggctattaatagatgagaggtgaagctaggctatatcagctgctgaggtaattatccagttgatatttatcttgttccagtcacctttagaaagctgtttggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctc

SEQ ID NO: 19751 - DNA, 347 bp, Homo sapiens
  ENST00000629180
gcttgctggctgaaaggaaggagaatcaaatttagaaatatctgaaaggaaatccagatataggctattaatagatgagaggtgaagctaggctatatcagctgctgaggtaattatccagttgatatttatcttgttccagtcacctttagaaagctgtttggaatcactaggtacttctaaatcactggagagtcaatctgaagtcagatgcatactccctgaatattagtctttcagctctcaaatctccaggcagcctctattgattgatctgagttggcagatgagttggcaggcaagggcagtgactggaagctgggagagagggtcaacagctgaatctc

SEQ ID NO: 19752 - DNA, 862 bp, Homo sapiens
  ENST00000625324
ctccctccagggttccccagtgtctattgtttggatctttatgtccacgtgtatgcaatgtttagctcccattcatcataagtgagaacatgttgtatttggttttctatgttaatttgcttaagataatagcttctagctgcatccatgttgccgcaaaaagtatgatttatttatttttttaaacttttaagttcagggtacatgtgcaggtttgttacataggcacatttttgtcatgaggatttgttgtacagattatttcatcacccaggtattacgctgtattagtctgttctcatgctgctcataaagacatatccgagactgagcaatttgtaaaggaaaggggtttaattgactcacagttcagcatgggtggggaggcctcaggaaatttacaatcatggcagaaggggaagcaaacatgtccttcacatggtggcagcaagaagtgtggagtgaagtgggggcaaagccccttatgaaaccatcagatcttgtgagaactcactatcatgagaacagcatggaggtaattatccagttgatatttatcttgttccagtcacctttagaaagctgtttgtaattaatcaaactcaataacagcacaaaagtaacaactcaggtgaaaagaaaactcacttatgtcttcaatgtccaatcaacattgccaaatgggagaacagttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctc

SEQ ID NO: 19753 - DNA, 238 bp, Homo sapiens
  ENST00000627108
acaatcatggcagaaggggaagcaaacatgtccttcacatggtggcagcaagaagtgtggagtgaagtgggggcaaagccccttatgaaaccatcagatcttgtgagaactcactatcatgagaacagcatggaggtaattatccagttgatatttatcttgttccagtcacctttagaaagctgtttggcaagggcagtgactggaagctgggagagagggtcaacagctgaatctc

SEQ ID NO: 19754 - DNA, 592 bp, Homo sapiens
  ENST00000601679
tcacttttgccatgaagcccagagcataaagctcctgggtctctgcacatgcccgagtggctactctgccaagattccatacagctctgtttgtcagactgaaggcgctggtgtagtgtattcatgaggggatctcctgaccagaggattgcaaagatccacgggagaagcatggcttcctggagtcacacattcactcactgctttccttggtagaggaggttccgttagctctgtgtttctcctgggtaattatccagttgatatttatcttgttccagtcacctttagaaagctgtttgtaattaatcaaactcaataacagcacaaaagtaacaactcaggtgaaaagaaaactcacttatgtcttcaatgtccaatcaacattgccaaatgggagaacagttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 19755 - DNA, 442 bp, Homo sapiens
  ENST00000627219
agaatcatcaggtggtgaagccagcctgacttgtgtccttcccttcatggtggtaattatccagttgatatttatcttgttccagtcacctttagaaagctgtttgtttaggatcagggaccttttgctgtggaatcaccaatgaatcaagacccctgtggaaaatgcaattaattaatcaaactcaataacagcacaaaagtaacaactcaggtgaaaagaaaactcacttatgtcttcaatgtccaatcaacattgccaaatgggagaacagttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatc

SEQ ID NO: 19756 - DNA, 770 bp, Homo sapiens
  ENST00000593878
aatcatcaggtggtgaagccagcctgacttgtgtccttcccttcatggtggtaattatccagttgatatttatcttgttccagtcacctttagaaagctgtttgttcatttcaggtggccctgttcctttcactcagaaactttgaagcaggttcttaccaaatgctctttactgtatcaggagaacaaagattgaagaaggtatgggcagtttgtgaatccagactcctggatttgtgctgctttgtgcattcatgatcacacattcacacagcccaatcaactatcacagagactggaaaatctcaagacctgaagatactacctttgatcaaactgtgacaatatttatggaattaaactacatggcacagtcatttaccttttaaaattaggtgtccaagagagaatccaaggggtgctgacaaggtctagataactgatacatttgacaacggacagagtgtccaaggaaaatatcaagaagcttcatcatgttcaactccgactgtgactacacaatgctctcaaatctccaggcagcctctattgattgatctgagttggcagatgagttggcaggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 19757 - DNA, 737 bp, Homo sapiens
  ENST00000596532
aatcatcaggtggtgaagccagcctgacttgtgtccttcccttcatggtgttctgcaccaattcaaatgagagaccctagaaaggagcctccagggaactccagctactgtatacatcatctgtggttttcaagcttcttgagccttgtaattatccagttgatatttatcttgttccagtcacctttagaaagctgtttgtaattaatcaaactcaataacagcacaaaagtaacaactcaggtgaaaagaaaactcacttatgtcttcaatgtccaatcaacattgccaaatgggagaacagagaacaaagattgaagaaggtatgggcagtttgtgaatccagactcctggatttgtgctgctttgtgcattcatgatcacacattcacacagcccaatcaactatcacagagactggtgtccaagagagaatccaaggggtgctgacaaggtctagataactgatacatttgacaacggacagagtgtccaaggaaaatatcaagaagcttcatcatgttcaactccgactgtgactacacaatggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 19758 - DNA, 394 bp, Homo sapiens
  ENST00000599956
aatcatcaggtggtgaagccagcctgacttgtgtccttcccttcatggtggtaattatccagttgatatttatcttgttccagtcacctttagaaagctgtttgtaattaatcaaactcaataacagcacaaaagtaacaactcaggtgaaaagaaaactcacttatgtcttcaatgtccaatcaacattgccaaatgggagaacagttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 19759 - DNA, 350 bp, Homo sapiens
  ENST00000597170
aatcatcaggtggtgaagccagcctgacttgtgtccttcccttcatggtggtaattatccagttgatatttatcttgttccagtcacctttagaaagctgtttgctctcaaatctccaggcagcctctattgattgatctgagttggcagatgagttggcaggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 19760 - DNA, 418 bp, Homo sapiens
  ENST00000629329
ggtgaagccagcctgacttgtgtccttcccttcatggtggtaattatccagttgatatttatcttgttccagtcacctttagaaagctgtttgctctcaaatctccaggcagcctctattgattgatctgagttggcagatgagttggcaggtctctactttgagttagatgacttcagaaatgatcacacatttcatgtcaaatttccaggcctcaaattcctgttcccagtgatatgagtacccacagataattcactggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtc

SEQ ID NO: 19761 - DNA, 239 bp, Homo sapiens
  ENST00000631137
ggtgaagccagcctgacttgtgtccttcccttcatggtggtaattatccagttgatatttatcttgttccagtcacctttagaaagctgtttgctctcaaatctccaggcagcctctattgattgatctgagttggcagatgagttggcaggcctcaaattcctgttcccagtgatatgagtacccacagataattcactggcaagggcagtgactggaagctgggagagagggtcaac

SEQ ID NO: 19762 - DNA, 309 bp, Homo sapiens
  ENST00000625381
ggtgaagccagcctgacttgtgtccttcccttcatggtggtaattatccagttgatatttatcttgttccagtcacctttagaaagctgtttgtttaggatcagggaccttttgctgtggaatcaccaatgaatcaagacccctgtggaaaatgcaattaattaatcaaactcaataacagcacaaaagtaacaactcaggtgaaaagaaaactcacttatgtcttcaatgtccaatcaacattgccaaatgggagaacagcaagggcagtgactggaagctgggagagagggtcaacagctgaatctc

SEQ ID NO: 19763 - DNA, 697 bp, Homo sapiens
  ENST00000631022
aaaagaattcagcaatggtgaggcaaatgatctttgtaataagattttcccaacttgaaatgttgaataaaagaccctatatcaaacttacacaggtcttggctcatggtaatctctggatgtgtgtgttgggtctgaatccatttatcttattagtggaagacagaatgtgaaattaagaaaattaatatttctatttctgttagaggaaagtttcttgataggtttcaaaatggccccattaagcaatctcaaattgataaaatgtagaccaaaatggaaggttaatttaattagaatgccataagtggactcttcctgactaaatcaaagactagtgttaattttcttaaattactctgttttgaattctttatataccatttagggtacctaatataatactttgcacaaaataaatgcttgatttatgaaattgtacatctgaagaaatataaaaggctctaacttttgattttaaaattgtttcactctcttgactgtatagtttatgagcctatgatcctggaaaacacgcttgctaaactgaccaattttttgctttttttttggtttgatttcttttttattctttttccttaggtaattatccagttgatatttatcttgttccagtcacctttagaaagctgtttggcaagggcagtgactggaagctgggagagagggtcaacag

SEQ ID NO: 19764 - DNA, 935 bp, Homo sapiens
  ENST00000444629
gtaattatccagttgatatttatcttgttccagtcacctttagaaagctgtttggcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaaca

SEQ ID NO: 19765 - DNA, 956 bp, Homo sapiens
  ENST00000610721
gagataagaaagaaaggattttgcacgttcctgggaatctaggcacgttttccttgtacctgttaaacgagactgccaggtatcacatgtttaaatatcagactatttctagaaccatcggatttcctggctccattccacttttatgcttcttcttggaggcagcttcacctccactcacattccggagataagcatgaactttggtaatacgatgaagacatgcttctttcttcttccatgcccagattttttcttaatccaaaataagttttaaagtgattgggggaggtgagggggaatactaatgatttaaatttttaccaaaacccatttacatttggatggtttcactttccacaaagaaaagcaacaaccctgactctcccaaaaaaacaaaacaaaacaaaataacaaaaataaagccaaacattaactacctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggaaaatcttggtccactacagaaggttgaacaacagtgacttaaacttcttgatgggtagaacacaggggtttagagcacatttgagctgggggacttcaaatcctgccttcgcagctgactgtgtgactctggaagattacttaacttctctgggcctcaatttcctaatctgttaaatggggatggtactgctcacttcagagtgctgttgttcatttcaggtggccctgttcctttcactcagaaactttgaagcaggttcttaccaaatgctctttactgtatcaggagaaca

SEQ ID NO: 19766 - DNA, 804 bp, Homo sapiens
  ENST00000598247
cacgttttccttgtacctgttaaacgagactgccaggtatcacatgtttaaatatcagactatttctagaaccatcggatttcctggctccattccacttttatgcttcttcttggaggcagcttcacctccactcacattccggagataagcatgaactttggtaatacgatgaagacatgcttctttcttcttccatgcccagattttttcttaatccaaaataagttttaaagtgattgggggaggtgagggggaatactaatgatttaaatttttaccaaaacccatttacatttggatggtttcactttccacaaagaaaagcaacaaccctgactctcccaaaaaaacaaaacaaaacaaaataacaaaaataaagccaaacattaactacctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 19767 - DNA, 853 bp, Homo sapiens
  ENST00000593848
ctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggaatcactaggtacttctaaatcactggagagtcaatctgaagtcagatgcatactccctgaatattagtctttcagctctcaaatctccaggcagcctctattgattgatctgagttggcagatgagttggcaggcctcaaattcctgttcccagtgatatgagtacccacagataattcactggtaagatcaccgagtgacccaggaatgaaacctaccattgaagatgtttatttagagctgtatccactgtccacagccaagggaaatagccttttctagactggatatatttgaccagtagatggagtaagtggatcccagaaccaccaactaaccacccagaacctgctgatcaatgctgttgtctttcaatattctatcaaaaagggacaatgccatcaccagcaactaaatcttgagcttaaggtgcatcttcggcaggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 19768 - DNA, 497 bp, Homo sapiens
  ENST00000435515
gctgcaaagatggccctgcctccatgccttgttgaacatgatgatgcccctgggaatgggaggtgatggttttttacttcggccctagtacagagtatgctcttgaagctggattccatcagcaggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaa

SEQ ID NO: 19769 - DNA, 852 bp, Homo sapiens
  ENST00000625780
ccctgggaatgggaggtgatggttttttacttcggccctagtacagagtatgctcttgaagctggattccatcagcaggcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgc

SEQ ID NO: 19770 - DNA, 842 bp, Homo sapiens
  ENST00000620276
ggatgagctacttgggcttagctcttttagaggccaaagtttattttcccgacaatcctcctcacatgcttgggccccactctggactcttaatgtagaagtaaaaaccgatgctgataacagaaagaaatgcatgattttctttggtaactcagtaccatttcatcattgtccgtcacgctgagggatgccttataaattcaatggctcatgcaatgcaaacaaatacttcctttagtaaggatggctgtgttgaatcttggcctgaaagatctttgacctgaaacaaaactacaacatccacagaaacgctacataaagtgtacagatctggagtgaagacgaagtatctggatggcaagactctctgtatatttgtcatgcattctgaagtggtaattgaaggcactgatgtgagctaatagacttttttccaaaggagtgaccttaaaagaaaaatcaaagaaatgtgaaatccaatattgtaataatatcactgctctcaaatctccaggcagcctctattgattgatctgagttggcagatgagttggcagttttttatctacaagttgggaataatatatgcattacgaagagattacaagtactaactggagaaaacaatctgagaccttggcaaataatagattatccaacttaattccaatattattaaaattagtgatcattagctggcactttacaacagaaatgatctgaataaattttcaacatatacatgctctgataccatgacaggaaaatgcaagggcagtgactggaagctgggagagagggtcaacagctgaatctcagcctgatggaggccaccatttaat

SEQ ID NO: 19771 - DNA, 324 bp, Homo sapiens
  ENST00000611583
acagatcagtgaaacaaaagaagaaaaaaaaaatccttgtcctgtccttgagatgagacaggtgcatgtaatatataataattaaagtatttagtatgctagatgtgctatggaaagagtacaggaaagctagggagatgaggagtaatgaggtgagagatggcagttgaaatctgaaataggatcatcaagctctcaaatctccaggcagcctctattgattgatctgagttggcagatgagttggcaggcaagggcagtgactggaagctgggagagagggtcaacagctgaatctcagcctgatggaggccaccatttaat

SEQ ID NO: 19772 - DNA, 790 bp, Homo sapiens
  ENST00000427354
agctctcaaatctccaggcagcctctattgattgatctgagttggcagatgagttggcaggcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctcctt

SEQ ID NO: 19773 - DNA, 800 bp, Homo sapiens
  ENST00000413479
ataggcttttttttttttttgaggaaaaagaagaaagagaaagagacaaaggaaaaggagaaagacaagagaggaagaagcaggaggaaaacagtggagagaagaagaaaaaagagaaaaaataaattacagctatctgggcttccatgggagtgccaactctgacagctgagacatctctgacttggctctttcacctcttgtgcaagggaagaacagcactatttttaaaggaggtcattagttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattg

SEQ ID NO: 19774 - DNA, 245 bp, Homo sapiens
  ENST00000619351
aaactcccaccagctatcaaatgaaggcgtcgggggagaatatatacagtctacagaactcgggagagttaaagagtagcaagttccaatcaagaagaaatgttttattcagtaattactttgaagaatttttttaagagcccctgaaaatactggatttctgcaggggatattgcgaaaatactaaaatactaaggcaagggcagtgactggaagctgggagagagggtcaacagctgaatctc

SEQ ID NO: 19775 - DNA, 344 bp, Homo sapiens
  ENST00000417875
aggcagagagggagaaataacaagaatggaagagtcgttcttccaaaaagggccatctgtgaccctgagagataaacctggcagaccagggctcacatcttagtaaatcacctgtaaataaagcttgcaagggcagtgactggaagctgggagagagggtcaacagctgaatctcagcctgatggaggccaccatttaataagtaaatacatgcacggctatttagatcctgcatcagacaggtcatcagaaaacatgaagctaaatgcagtaaagaattactctcttgaactcttgaaaatatcaaaaacatgaagctaaatgcagtaaagaattagtctctt

SEQ ID NO: 19776 - DNA, 5234 bp, Homo sapiens
  ENST00000236877
acacaggagcgccctccggtgctgtcccctgcctctggtgctgaacccggaggctggggaggaggctcgggctccctgctcccccaggcccctccccgggcctccccccgcctcccgcaccgccttccctctgcccgcctccgcctcctccccctctctccggctcctccccctccctcgctccctcgccgcctccccctcccccgtgtccctcccctctcctcttctcctccctctatcccctctccctcccctcctccccggctctccctctcagtctcaggcttttctctctctcaatctctctctctctttcgggcggagtcgcccaccactgccagcccagcgctggggggacctgctccaggctgtagccgcaggaccccaccaccccccatggctcccctggccttggtgggggtcacactcctcctggcggctcccccatgctccggggcagccaccccaaccccctccctgccgcctcccccggccaatgacagcgacaccagcacagggggctgccaggggtcctaccgctgccagccgggggtgctgctgcccgtgtgggagcccgacgacccgtcgctgggtgacaaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgaccccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccgttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccactacccttctctcccccagctcatcatcagtcgctgtctcttttctgtgatttctgtaaaagttgccataaaactttgaaattctgcctgaaaaacagtcccgtgggaagctgggattcaggaggagggggctaataaggtctctgactgagatttgggcaactgttaaaccaagtaatctgggtttttgcggcccgcggtcgtctgcgggacacacccacatatagcagcagcgccggggtccagccgccaagctcttccactcgccacgcccccatcagtaatgagcttccactagccacgcccccatccgtcagcctagctcttccactagccacacccccatccatcagtcatgggcttccacaagccacgcacctccactctccatgcccccattcgtcagtcgtgggtttccactaaccacgcccccattcatcagccaagctcctccacttgctacgcccgcatccgtcaattacgggtttccactaaccacgcccccattcatcagcctagctcttccactaatcacacccccacttatcagtcgtgcttcagccacgccttcctgcttcagtcaggggcttccactagccacgcccccatgcatgagccacaaactgtttctctttatgggcatcctgggaacacaaaagagagacgttcatttgcctgagccaaagagctggggttgatggggtttcctaaataaagcaagtaattttctcagatccta

SEQ ID NO: 19777 - DNA, 3603 bp, Homo sapiens
  ENST00000542837
tcaatctctctctctctttcgggcggagtcgcccaccactgccagcccagcgctggggggacctgctccaggctgtagccgcaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgaccccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccgttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccactacccttctctcccccagctcatcatcagtcgctgtctcttttctgtgatttctgtaaaagttgccataaaactttgaaattctgcctgaaaaa

SEQ ID NO: 19778 - DNA, 1606 bp, Homo sapiens
  ENST00000539381
ctctctctttcgggcggagtcgcccaccactgccagcccagcgctggggggacctgctccaggctgtagccgcaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttg

SEQ ID NO: 19779 - DNA, 633 bp, Homo sapiens
  ENST00000600576
aagggattctgggaaagaagttcattcaatgggacttgctgtcaggaagttagacaaaatggggcctctgtaggcaaggaaggaagtctgagtgtatgccccagctgggtcgtgtgcccacaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgc

SEQ ID NO: 19780 - DNA, 575 bp, Homo sapiens
  ENST00000601757
gacgtgggcggggcttcactgaacagctgggccctcaggaggagaggggcctgagtgaatcgttctccaaagtgggcttggcctcgggaggggcggggcctaggtgtgctgtgtctaccacgtgggcggggcctggtggggttgtgactgtgaaatgaagaggcgaggcctagaagggtggccggacaggaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagc

SEQ ID NO: 19781 - DNA, 581 bp, Homo sapiens
  ENST00000594353
tctctctctctctttcgggcggagtcgcccaccactgccagcccagcgctggggggacctgctccaggctgtagccgcagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttct

SEQ ID NO: 19782 - DNA, 570 bp, Homo sapiens
  ENST00000597014
agtctcaggcttttctctctctcaatctctctctctctttcgggcggagtcgcccaccactgccagcccagcgctggggggacctgctccaggctgtagccgcaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtg

SEQ ID NO: 19783 - DNA, 5250 bp, Homo sapiens
  ENST00000356921
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 19784 - DNA, 5146 bp, Homo sapiens
  ENST00000494208
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 19785 - DNA, 5268 bp, Homo sapiens
  ENST00000381269
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagcgctcctgttatctccagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 19786 - DNA, 2916 bp, Homo sapiens
  ENST00000216568
gagtatcaactcttccagcatggagccgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagaggaaaaccataagggttaaaatagtagatgaggaggaatacgaaaggcaagagaatttcttcattgcccttggtgaaccgaaatggatggaacgtggaatatcagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttc

SEQ ID NO: 19787 - DNA, 2622 bp, Homo sapiens
  ENST00000394330
cgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggc

SEQ ID NO: 19788 - DNA, 2837 bp, Homo sapiens
  ENST00000534137
gtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaa

SEQ ID NO: 19789 - DNA, 2840 bp, Homo sapiens
  ENST00000528359
gtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtcaaaacaattcacatcaaggtaattgatgatgaggcatatgagaaaaacaagaattacttcattgagatgatgggcccccgcatggtggatatgagttttcagaaagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaa

SEQ ID NO: 19790 - DNA, 3409 bp, Homo sapiens
  ENST00000533541
cgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccaggtgagagtgagaggtgcttgaatttgcaaagaggattttacctggttcaaatgacccctggactccatctcattatcttccacaccatctcagatctgaacttaacagagcctctgcccttaaagtgcacaaaagtcaatcaaagagatgaataatgacattagtaatgacagctaatatttcttgagcactttcaatgtgacagacaccatgtgtgttcagcaatttacacatttacattttccccctgtaatgtttcccaaagccctattaaatagggtaagttattatccccacttcacagacaaagaaactgaggcccacagaggttaagctacatgcccaagtaagtggtccaatttcttaacctccacattatgtgagtagaccacaaacagtgaaattaaaagaatgtagatattgttctccttctatttacctctggcgatctctgagaggttaaagattagccagctcaaagatatcaaaggagaaatgcccacatacattcttggcctcctctacttggaaggacactgtgagtacaaagtatctcctagcaggacagccaaaggaagttccacagcttttatctttttataggatgaattacatactctttctttttcttaggaacactcagagacaaacagaaaggagcggacattcctttactcattgaacaaatatttactgagcacctattatgcctgttacagtattgtgctagtttttgggactatagtgaaaggcaagatacacatgcttccttctccacgtggagtttataatctactgaaggaggcaactctcaactactgtaattaaagttatcttgttaaatcctaggaagaaaaagaaaaggtactgcatacggaaggaagttgggcctgaatgtaggagttagcaggtagacaggggctgcactagcccaggttctttacttaattcagttaggggctttggggcctctgaactctgaacttctgccagggagctggcatcccagttgccccagaaagaaacagagcacatcctcctgcagggaagttaggctgaatctcatcagacaggacttttctggctgggccaagggaaatctttcctgtaccaagcaaacatatccttcaagagagtagctgaattcacatcaaattctaggaaaacctctttccaaaaccccagcgcaggccagcggtattatttgtccattagtgatgcaagagatttagctatcgtggaaatgcatcagaaggttggaaattagatggatgatcccaggaaggcctgtggatgagatgccctgtgatctctgttctccaagccttgggggacctgaactatcagaggggagggaggaaatatgggggaaagcatagaggtgggaagaaatatcagaggatcagaagcaaaaaacaacaataacaacagaaacaaaaacaaacaaacaaacaaaaaaacaaggccataggcaagaaagggtaagaggttttctctgggagatctaaaaaaaatggcaataatgaggtaagccaggcagatacctttgggcatctccaagtccttgcaattggccaagacaacagctaacaacatttgaggctttaagaaggttaccctgtgatccactcatctgatttagtggctttggctgaagctctttggatatagttgaaggtatggaaagggtccttacatgaggactttagggtcaagtctcttgctaacatcctatgtgaccttgggtaaattctttgacccttatttttcttacctgtaaaataaaagaattgggctagatgtctctgacagtcctccctgtatctacaatctgtgccaagatctaaagtcaaacaccctgcaaggccctgtgatacatatataaaccacaaagacagagccccgtcttccttgagtccacagttcaccctgcatgtccccatcatggttccccaacatgtcctctgtccccaaaatccagcacctcacccagtgctcaatcagtaggcattgctcaataactgttggtggttcgtgaataaatgccccatatgacagttaaaatcaggcatctactccaagcagcttcccagggtgtcaaggttccctggggagatattatgggatggcaaacttcccttactgaaaaagtagtcaaaggagaacaataagcccactcagtaaatatcagaactggaaagcccttcagaatctttcagatcactgcagatgaggaatgggaagcccagactagggatgtgacctacccagggccacacggcttgcttgcggcagaactaggagttaggagtggccccctagcccttgtctctcattcctgggttcagcccaccagctcaagctgctttttgggcatactggaagacaagccctgcacaccttagcctcctaccagttcccatgtgtctttgtccttttccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgc

SEQ ID NO: 19791 - DNA, 488 bp, Homo sapiens
  ENST00000533899
gaaaaccataagggttaaaatagtagatgaggaggaatacgaaaggcaagagaatttcttcattgcccttggtgaaccgaaatggatggaacgtggaatatcaggttattcacttgtggagtggcccataggcccctctgcccttcgaggaggagagatatgctgctgggagcctcctagcaaatgaagcagtgaaatccacctgtttgtcaaaaaggggtgatcatactgcaattagttcatattcatgtgacaaagagcagcataaaactttccacacgaggacagagctaagagattcagcaacaacattcccaaaggattctctacaggccttctcagtgtgattggtcatttctcattgtctgctggggactctcctgcagagctgaccacttctgtgcctgcgctggtttggacacacctgatgctctaggggcagaactcctctccttcttcactgctggttctcttcgtcaccactcaat

SEQ ID NO: 19792 - DNA, 5259 bp, Homo sapiens
  ENST00000357887
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtcaaaacaattcacatcaaggtaattgatgatgaggcatatgagaaaaacaagaattacttcattgagatgatgggcccccgcatggtggatatgagttttcagaaagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctac

SEQ ID NO: 19793 - DNA, 3289 bp, Homo sapiens
  ENST00000552014
cgaggttcggagtttgctggtcccaggcccggcccgagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaagtgtagagaaaa

SEQ ID NO: 19794 - DNA, 2287 bp, Homo sapiens
  ENST00000552565
aatggggacctggaggtctctcgctgtgcttgggtattacctccttgattgcaagggagacaggaagggagatggtcctggaaggcaggaggaaggagtggggagctcaaggaaaaggccatttacccactggtacctggatgggctaacacagattgccaccgctaacacgcaccactgatagaactgccagctgttgttctctagacctgcaccaggacaccacttggtgacggcgtgcaccccgtctgcaggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttc

SEQ ID NO: 19795 - DNA, 2925 bp, Homo sapiens
  ENST00000550672
ccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagacgaggaggatgcaggtggctgggaagacgaaacgccacggtgcctagaaacagcccacacggtacctcatgtcttcactgcgtgttggatatacctgctaagtgtggaaggaagagaagcggggaggggacatttcagtcccttttactcttctgtactgcttgaaaatatgtcagcaaccatgtgtgacatgtataccatagatagtgttagttccctagtgctgccataactgaccacaaaccagggggctgacaacagcagaaattgagtctctcccagttctggaagccaaaagcctgcaatcagggcatcagccgggcagtgccacctccaagctccagaggaggatccttcctcacctcttccagctgctgttggctcctgacgttccttgcccagtgggcccatctctgcagtctctgcctctgtgttcccatggccatctctctcttcttcttacggagacatgagtcattggatttaggggccaccctaagtccaagatgattgtatcttgaaacccttagcttattatatttgcaaagaccctatttcagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaa

SEQ ID NO: 19796 - DNA, 2493 bp, Homo sapiens
  ENST00000550047
tgtttagtgcttaatgattttttaaaattttagtttttacttttggaaactcaatgaatgtaccaaccgaagggtgttgaattttcagcaaatggatcatttagggaagttgccttttactacttagggaaaattgtctttcactgttttttcaagtaccgacgtgtgccacaacatggatcacccttgaaaacatgatgctgagtgagagaagactgtagcagaggatcacacactgtggcattccattgatgtgaaatgtccacgaggcacattcagagagacagagagcagagtagtggtcgagttgggctggtggggtggggctagggagtgaccgctaatgagtacagggatacttattgggatgatgggtggtatttggttcatagactggaaatctgatgaaagtgataaggaaccctttccagacaaaataatatttttttttagtatatgaaagggaggtttttttgtttttattttttttcttttttcgagacagagtctcactcagtcgcccaggctagagtacactggcatgatctaggctcactgcaacttctgcctcccgggttcaagcgattctcccacctcagcctctcgagtagctgggattacaggtgtgtgacaccagcctgactaatttttgtatttttagtagagacaaggtttcaccatgttggccaagttggtctcgaactcctgacctcaggtgatctgcccgcctcggcctcccaaagtgctgcgattacaggcggtgagccaccgtgcccggcctgaaagggagtttattaaggaaaaaagaaaataatattgaactcacgttttattgagcactaactttgcacaggcaccaatgcatatagtaacgtgttttatactcataataagctcatgaggtagatactgttatcatcccgtttcacaggtgaggaactgaggctgtgttcctgttggggctggccttggtcccacagcaaaccattccctccgcagctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtc

SEQ ID NO: 19797 - DNA, 1058 bp, Homo sapiens
  ENST00000549069
gccactgtgcccagctggtagccgcgtttttcacacctgcaaagttgttcctggtgtgaaagagtggggtaaaggaattaaggagggaagtgtgtcttcccagatgctgtgccccctcacacagcaccccaccagctagtgcccaggcacacttgggcatccatctgtgtttgttgcctgaatgaccgtgggtgagaatgaaggcgtggatgaccagggagggtgggggaagcgactcaccactgcaggcccctcttgttcctgtgcagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactc

SEQ ID NO: 19798 - DNA, 1656 bp, Homo sapiens
  ENST00000546737
ccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtga

SEQ ID NO: 19799 - DNA, 1675 bp, Homo sapiens
  ENST00000553238
cggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactgggtgaggaactgaggctgtgttcctgttggggctggccttggtcccacagcaaaccattccctccgcagctctttgctttcctgggctttctgaccagcgccctgtggatcaac

SEQ ID NO: 19800 - DNA, 549 bp, Homo sapiens
  ENST00000551230
acccggactggcggcttcgctggcgcaaggtcggtccggcggccagggacctggaaggctgcgaggccctgcgaggtcgaggttcggagtttgctggtcccaggcccggcccgaggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcg

SEQ ID NO: 19801 - DNA, 2053 bp, Homo sapiens
  ENST00000548477
gaagagtaggggcccggacgctgcagcaggcggggcacccggactggcggcttcgctggcgcaaggtcggtccggcggccagggacctggaaggctgcgaggccctgcgaggtcgaggttcggagtttgctggtcccaggcccggcccgaggtaagaaagagccgcctccccgcacggccggaggacccgggcgccccgagttcgacttctcagcctccgtccggacgggaaacggagcacggagatgttcctgaggtctctttcctgggaagcgcagccccgatttcccgcccctgtcccttagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcagtgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcagtatccttttgtccagtgtcctgcaccctggagggagggcagttgtggggaggctgggagatagggtcatgtctatccccgtgtggggaagctgggggatagggtcgaaggcctgggtgggctgcagctgcgatcctggcccgccttgacatgctccccacatggcgtcaccttcctggcatttgggaatggtgcacctgacatcttcagtgccctggtggccttctctgacccgcacacagccggcctggcccttggggcactgtttggtgagagcagccccagtgaggggggcggggaaagcagcaggagagggtgcagggtggctgagctctggcctcctccccccaggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggtgagcagctctggggctcaggcgtgagatcccagggctgatgggcaggaggtttaggaggtgcctgggacagagaggtgtgaggggtggtcagtgggggctttgatttgattacaagtgacagaaaccctcctcaagctggcttgagcaaaaatgggaacatgtgggtcacataaccaaagaggcctggcagagctgggggctggggagggagtattcaaaagtgtcacaattttttggccaagcgtgatggctcacacctatcatcccagcaatttgagaggctgaggcaggaggatcactttggttcaggagtttgagaccagcctgggcaacatagcgagactacatctctac

SEQ ID NO: 19802 - DNA, 925 bp, Homo sapiens
  ENST00000549181
agagtaggggcccggacgctgcagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgg

SEQ ID NO: 19803 - DNA, 850 bp, Homo sapiens
  ENST00000549605
tgcagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcagtgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttcc

SEQ ID NO: 19804 - DNA, 647 bp, Homo sapiens
  ENST00000552613
ccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcagtgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggca

SEQ ID NO: 19805 - DNA, 996 bp, Homo sapiens
  ENST00000548186
agcaggcggggcacccggactggcggcttcgctggcgcaaggtcggtccggcggccagggacctggaaggctgcgaggccctgcgaggtcgaggttcggagtttgctggtcccaggcccggcccgaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctacca

SEQ ID NO: 19806 - DNA, 555 bp, Homo sapiens
  ENST00000549372
aagacaagggaggagcagagccctagcaggatactaaatgggtctatgtgactttagggaccctctgcttttggactagcctggaacccaggttcagtcctgctgacctggcactggaagggaggcagggtgctggcacccacgagcaagccacagccaagcaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctac

SEQ ID NO: 19807 - DNA, 664 bp, Homo sapiens
  ENST00000548518
aggatactaaatgggtctatgtgactttagggaccctctgcttttggactagcctggaacccaggttcagtcctgctgacctggcactggaagggaggcagggtgctggcacccacgagcaagccacagccaagcagactgatctcggctgggattacaggtgtgagccactgcgtctggccccaagtaactttttaacacagttcttcaactgcataccttcaatctaagaatggtgatatctaagcctcaccctagctaccagggtcaggccccttggggaaggaggacttcaaactcagcaattctggagttacttctcaagcagcagatgacctggggaaaagctgaccccggagtaggatgaccccggagcaggcttggagattgtgacacacagacactactgtgaacgcccctgtgctggcagcctggacatggggatgaacctggcctggtgctgcttcgaggtgctcccagcctgtgggggacatggaaaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctct

SEQ ID NO: 19808 - DNA, 2975 bp, Homo sapiens
  ENST00000202831
cagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaagtgt

SEQ ID NO: 19809 - DNA, 2584 bp, Homo sapiens
  ENST00000264938
gcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtcttcttcttctacctgctgccccccatcgtgctggacgccggctacttcatgcccaaccgcctcttcttcggcaacctggggaccatcctgttgtacgccgtcgtgggtaccgtgtggaacgcggccaccaccgggctgtccctctacggcgtcttcctcagtgggctcatgggcgacctgcagattgggctgctggacttcctcctgtttggcagcctcatggcggctgtggacccggtggccgtcctggccgtgtttgaggaggtccatgtcaacgaggtcctgttcatcatcgtcttcggggagtcgctgctgaacgacgcagtcaccgtggttctgtacaatgtgtttgaatctttcgtggcgctgggaggtgacaacgtgactggcgtggactgcgtgaagggcatagtgtccttcttcgtggtgagcctggggggcacgctggtgggggtggtcttcgccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagggcctgaccatcaagcctctggtgcagtggctgaaggtgaagaggagcgagcaccgggaacctcggctcaacgagaagctgcacgggcgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgagggagagcgccgcgggtccctggccttcatccgctcccccagcaccgacaacgtggtcaacgtggacttcacgccacgatcgtccaccgtggaggcctctgtctcctacctcctgagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcggccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttctgccgcctgatgcccttccgcctcagcagcaagtccgtggactccttcctgcaggcagacggccccgaggagcggccccccgccgccctccccgagtccacacacatgtgacaccggctccgacacgccgctaaccggccgctcgtccccgcgccacggtccgcccaccgccgccgccgc

SEQ ID NO: 19810 - DNA, 2504 bp, Homo sapiens
  ENST00000514375
aggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtcttcttcttctacctgctgccccccatcgtgctggacgccggctacttcatgcccaaccgcctcttcttcggcaacctggggaccatcctgttgtacgccgtcgtgggtaccgtgtggaacgcggccaccaccgggctgtccctctacggcgtcttcctcagtgggctcatgggcgacctgcagattgggctgctggacttcctcctgtttggcagcctcatggcggctgtggacccggtggccgtcctggccgtgtttgaggaggtccatgtcaacgaggtcctgttcatcatcgtcttcggggagtcgctgctgaacgacgcagtcaccgtggttctgtacaatgtgtttgaatctttcgtggcgctgggaggtgacaacgtgactggcgtggactgcgtgaagggcatagtgtccttcttcgtggtgagcctggggggcacgctggtgggggtggtcttcgccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagtggctgaaggtgaagaggagcgagcaccgggaacctcggctcaacgagaagctgcacgggcgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgagggagagcgccgcgggtccctggccttcatccgctcccccagcaccgacaacgtggtcaacgtggacttcacgccacgatcgtccaccgtggaggcctctgtctcctacctcctgagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcggccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttctgccgcctgatgcccttccgcctcagcagcaagtccgtggactccttcctgcaggcagacggccccgaggagcggccccccgccgccctccccgagtccacacacatgtgacaccggctccgacacgcc

SEQ ID NO: 19811 - DNA, 587 bp, Homo sapiens
  ENST00000507407
tgccctggtggtgcttctggatggagacaaggtcaaggagaagaacctgttcgtcagcaccaccatcatcgtagtgttcttcaccgtcatcttccagggcctgaccatcaagcctctggtgcagtggctgaaggtgaagaggagcgagcaccgggaacctcggctcaacgagaagctgcacgggcgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgaggtagcagagccgcttgctctgccgggtcggggctgcagcaggctctggcactggctgtgggtgccatggggcagtgaggagaggcccctgcacccgcgtcccaaggccaggcccaccccagcagttcacgggaggctgatgggccttctgatgccctgggaatcccaggggctctcgtggggtaaactgagtcacagag

SEQ ID NO: 19812 - DNA, 221 bp, Homo sapiens
  ENST00000628307
gcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcg

SEQ ID NO: 19813 - DNA, 219 bp, Homo sapiens
  ENST00000626862
aggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcg

SEQ ID NO: 19814 - DNA, 3627 bp, Homo sapiens
  ENST00000316549
aaaagagacagggctgctttaagagagaaacaggaagttgtaactagaagccatctgaatactaagccagggcagaatgcttgtgaagtagcaactaaagtggcagtgtttcttctgaaattctcaggcagtcagactgtcttaggcaaatcttgataaaatagcctttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatggccttataatgggactaattttacgatatgctacagcaccaactgatattgaaagtggaactgtctatgactgtgtaaaactaactttcagtccatcaactctgctggttaatatcactgaccaagtttatgaatataaatacaaaagagaaataagtcagcacaacatcaatcctcatcaaggaaatgctatacttgaaaagatgacatttgatccagaaatcttcttcaatgttttactgccaccaattatatttcatgcaggatatagtctaaagaagagacacttttttcaaaacttaggatctattttaacgtatgccttcttgggaactgccatctcctgcatcgtcatagggttaattatgtatggttttgtgaaggctatgatacatgctggccagctgaaaaatggagactttcatttcactgactgtttattttttggttcactgatgtctgctacagatccagtgacagtgctggccattttccatgaactgcacgtcgaccctgacctgtacacactcttgtttggagagagtgtgttgaatgatgcagtggccatagtccttacatattctatatccatttacagtcccaaggagaatccaaatgcatttgatgccgcagcattcttccagtctgtggggaatttcctgggaatcttcgctggctcatttgcaatggggtctgcgtatgccatcatcacagcactgttgaccaaatttaccaagctgtgtgagttcccgatgctggaaaccggcctgtttttcctgctttcttggagtgccttcctgtctgccgaggctgccggcctaacagggatagttgctgttctcttctgtggagtcacacaagcacattatacctacaacaatctgtcttcggattccaaaataagaactaaacagttgtttgaatttatgaactttttggcggagaacgtcatcttctgttacatgggcctggcactgttcacgttccagaatcatatctttaatgctctttttatacttggagcctttctagcaatttttgttgccagagcctgcaacatatatcccctctccttcctcctgaatctaggccgaaaacagaagatcccctggaactttcagcacatgatgatgttttcaggtttgcgaggagcgatcgcatttgccttagctattcggaacacagaatctcagcccaaacaaatgatgtttaccactacgctgctcctcgtgttcttcactgtctgggtatttggaggaggaacaacccccatgttgacttggcttcagatcagagttggcgtggacctggatgaaaatctgaaggaggacccctcctcacaacaccaggaagcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacagatgtaatcacaagtaatgcaagactcactgaggaatacaagccaagctgatgaggcagtacaggggagaggctggaaaacatattaagagcataaattggagagaatcaaagccttgtcacatggatcctctggtgcctgaagaaatgagattttattatccctctctattatgcaaatgaatttagttttttgacagcagccattctgattactggattggctggggtggggatggaggtatcaggagtctagctgctggaggatgggacagctgtgctgggtcttcagggcatttctgctgcgaatgcggctctccaggcccttcacttctattctggattttattccctccattaaggagagtttaaaaataaaagaaagcttctgagagtaaacattttgctcctaagctgaagggaatgcccagctatttagtaagtgataagtttcttattttgaggacttgactcccatttgctctcagtgaccccagggcagagcccagagaagtgttccgtacccactgctgatggtttcccagagcccacactgagttgaagaacctattgttcttcttggcatccttcttatgctacttctcccatcgctcaaaggggttgcctatggctgggtgtgccctgccctaaatgcagcaccactttcaagcttagtaggaccattccaagaaaaccaggtttcttctccccataccacgttgtgcctgaagaacaagccttcccgtccttgcctgcatgtgagtcacttcttggctgtgcagcaggtccccccctccccgcgatatgctggagggtaggattctgcagcctgtgttgctctctacctggcagcagactgtgcaggagccccaacctgtcctccaattccagcattcacagctgatgagcagtgcaggagcagggcgagaggaacagagccaatgatgtgtgggttacactgaggagccaaggacagggcctcaggtctcccccttacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagta

SEQ ID NO: 19815 - DNA, 569 bp, Homo sapiens
  ENST00000483124
aaattgcgtctatcctgtcctgagtcatcgtgccttctatgaagtgatgacagaaagaatataccactctgttaattatgtatggttttgtgaaggctatgatacatgctggccagctgaaaaatggagactttcatttcactgactgtttattttttggttcactgatgtctgctacagatccagtgacagtgctggccattttccatgaactgcacgtcgaccctgacctgtacacactcttgtttggagagagtgtgttgaatgatgcagtggccatagtccttacatattctatatccatttacagtcccaaggagaatccaaatgcatttgatgccgcagcattcttccagtctgtggggaatttcctgggaatcttcgctggctcatttgcaatggggtctgcgtatgccatcatcacagcactgttgaccaaatttaccaagctgtgtgagttcccgatgctggaaaccggcctgtttttcctgctttcttggagtgccttcctgtctgccgaggctgccggcctaacagggatagttgctgttctcttctgtggagtcaca

SEQ ID NO: 19816 - DNA, 591 bp, Homo sapiens
  ENST00000474727
gaagccatctgaatactaagccagggcagaatgcttgtgaagtagcaactaaagtggcagtgtttcttctgaaattctcaggcagtcagactgtcttaggcaaatcttgataaaatagcctttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatgatgacatttgatccagaaatcttcttcaatgttttactgccaccaattatatttcatgcaggatatagtctaaagaagagacacttttttcaaaacttaggatctattttaacgtatgccttcttgggaactgccatctcctgcatcgtcatagggttaattatgtatggttttgtgaaggctatgatacatgctggccagctgaaaaatggagactttcatttcactgactgtttattttttggttcactga

SEQ ID NO: 19817 - DNA, 579 bp, Homo sapiens
  ENST00000474151
agaatgcttgtgaagtagcaactaaagtggcagtgtttcttctgaaattctcaggcagtcagactgtcttaggcaaatcttgataaaatagcctttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatggccttataatgggactaattttacgatatgctacagcaccaactgatattgaaagtggaactgtctatgactgtgtaaaactaactttcagtccatcaactctgctggttaatatcactgaccaagtttatgaatataaatacaaaagagaaataagtcagcacaacatcaatcctcatcaaggaaatgctatacttgaaaagagacacttttttcaaaacttaggatctattttaacgtatgccttcttgggaactgccatctcctg

SEQ ID NO: 19818 - DNA, 712 bp, Homo sapiens
  ENST00000498717
taagccagggcagaatgcttgtgaagtagcaactaaagtggcagtgtttcttctgaaattctcaggcagtcagactgtcttaggcaaatcttgataaaatagcctttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatgacaagccgccgaaatttgccatgtcacgagagcaaatgtcacagtcatgttctcacacggcacataatgcaagtctgttgacagatgcgggtccattgtcatgtggggagtcgagggcgagctgtttgtttttgtaatgatgttgggaagtgatggctctgcagtcacaaagagcagccttctctcactggctgcaccgatgaacattacgaagttctagaaaaaacatcacttcaaaatgcctggagtaattcctcttatatcaactaatttcaagaagaaaacttgcagaaactaaccccacccctcttaagagaatattgtgtccaagtcctttttatttatacgaacagtgtcttattttcttataataaaaagttataaataaac

SEQ ID NO: 19819 - DNA, 582 bp, Homo sapiens
  ENST00000526660
attagacctctgcagactgtagactttcaactgcagactgggaggttactaagtccttagcagctgagtacagaacacgatggaaatgaaaacatggtacaacagaggttacagccctctcctgacctgataaacttcatgatggagctaaagatggtttgggaagtttctttgaatcacaagcagaactgtatgtgctgtctcctcctgtctggatctactcactacttgctaaagagaagaattttggtttgggataaatttatgtggatcttcgctttggtgccataaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcat

SEQ ID NO: 19820 - DNA, 578 bp, Homo sapiens
  ENST00000531713
aactgcagactgggaggttactaagtccttagcagctgagtacagaacacgatggaaatgaaaacatggtacaacagaggttacagccctctcctgacctgataaacttcatgatggagctaaagatggtttgggaagtttctttgaatcacaagcagaactgtatgtgctgtctcctcctgtctggatctactcactacttgctaaagagaagaattttggtttgggataaatttatgtggatcttcgctttggtgccataaagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcag

SEQ ID NO: 19821 - DNA, 4494 bp, Homo sapiens
  ENST00000289575
aaaaggacaggctgaggctgagcctcagggaggcggggtgcagcttcctcttcacagagaggctggacttgaacaaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatctttatattctggtctaatttttgtttgagtgtcttcgtctactaatggtttcaaaaatggaataaggtcatgaggatttctgaatcctcacctgtccaaattgtcattcacattttatagaagaggaaactggctcagaaagcacaagtgact

SEQ ID NO: 19822 - DNA, 2593 bp, Homo sapiens
  ENST00000532236
aaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggataggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagc

SEQ ID NO: 19823 - DNA, 1720 bp, Homo sapiens
  ENST00000531756
cttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggataggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttgggtaaagatcttgcttgggaccattggtggtggtgatggggtccagatgcccactgtgtgccaggcctggggcacaggcatgagcggaattcaatccctgatcttagggctcacaagctcatggggtgacagacctggcccagctctcctagagcggggtatagaggcagagtctagacagcccgtcaggaagccacctcggatgcaggggtggggcgggcttgagggccagacagccaagaggccccagtaacccagagcccctgaggggttgtacatgccagggagggggcagggtaggacggtgggccttcattgtcccctgagcaccacctccctcagcctg

SEQ ID NO: 19824 - DNA, 588 bp, Homo sapiens
  ENST00000531457
aaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaaggtacctctcagggcctggcaggggcctccgagtctagaagagcaggctctgccacgtgctggtggtgtaatgccaaggaagactttctctgagcctcggtttcctcatctatagaatgtgtggctgtgaggatcaaag

SEQ ID NO: 19825 - DNA, 2121 bp, Homo sapiens
  ENST00000525650
caagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcag

SEQ ID NO: 19826 - DNA, 3219 bp, Homo sapiens
  ENST00000454962
ccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggataggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgta

SEQ ID NO: 19827 - DNA, 224 bp, Homo sapiens
  ENST00000530556
aacgaagaggcacacaggaggtcggagaacacaatatcaacagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 19828 - DNA, 373 bp, Homo sapiens
  ENST00000534004
atttgggcaaggccccacttgctcccagaagcccagcagggagagcttcataggccatggagacagacccagctgaggagcagctgcagggactccaggagaacgcagccatggcttggggactgcagtacggcaggaagggtgggatggatgcctcctctcggggcacctcacaggacagatgagaatgagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 19829 - DNA, 546 bp, Homo sapiens
  ENST00000527180
attttacccaatccctactcaagatgaagatggagatggagatggggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccct

SEQ ID NO: 19830 - DNA, 274 bp, Homo sapiens
  ENST00000525845
aaacagccatatctctaaaggataaagtactcccaggaaggctttgagccttggcagaaaaggctgggattgaagcttcagggagagccagagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 19831 - DNA, 577 bp, Homo sapiens
  ENST00000534186
agccatatctctaaaggataaagtactcccaggaaggctttgagccttggcagaaaaggctgggattgaagcttcagggagagccagaggtgaggctggagtgggagatcacctgaggcaggtgagcaggctccatgagtgggcagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccct

SEQ ID NO: 19832 - DNA, 2368 bp, Homo sapiens
  ENST00000428359
atatctctaaaggataaagtactcccaggaaggctttgagccttggcagaaaaggctgggattgaagcttcagggagagccagaggtgaggctggagtgggagatcacctgaggcagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaa

SEQ ID NO: 19833 - DNA, 649 bp, Homo sapiens
  ENST00000526839
gtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtgagcctcaggagcacatgtttgctagaccctagctaactgactgccactctcataggagacattgagccaggggacctcggttcaaatcctagcagcaccactgaccttgggcaagtctcttagcctctctgaacctcagctttctcatctgtgagataatctctgtcctgtctgtctcctaaagctgtgatcagagtccagcgagatggtggagataaactgtaaagtgccatcaaa

SEQ ID NO: 19834 - DNA, 757 bp, Homo sapiens
  ENST00000530012
gtagaagggtcactgaggtgcagagatgtttgaagaagctcaaaggcttgtaggattgagggggcctgtctccatacttgcccaccttcattgcaaggagctcactatcacgccatcatcgggcagccctgatgatgaaaatcctctgtgtggagctgaaatctctggccattgctctcggctacagggccgaggatgccccagctagtggcctaagggagggaagccaggccaaccctactggtcttctctcccaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaata

SEQ ID NO: 19835 - DNA, 582 bp, Homo sapiens
  ENST00000528108
agagatgtttgaagaagctcaaaggcttgtaggattgagggggcctgtctccatacttgcccaccttcattgcaaggagctcactatcacgccatcatcgggcagccctgatgatgaaaatcctctgtgtggagctgaaatctctggccattgctctcggctacagggccgaggatgccccagctagtggcctaagggagggaagccaggccaaccctactggtcttctctcccaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaaggtgaaggtggggg

SEQ ID NO: 19836 - DNA, 5875 bp, Homo sapiens
  ENST00000530015
tgtctgcagctgccagggctggaggtgagaggcccagagggctccagctgtccaggccagccagccacttcaagggttgatgggactaatccctgcacacctgtctcccatctgaggccctgtgtggctggggcacatgagtctagaagctctggtctatgggaaagcaaagagaagcccaggcctcttggcttgggctggcttctatcgggtgcctgtgagccctggcagtccagatcacttcgcagagtccttggctggaggttttcctcgctacctagggagtgagtgcaggctgggatcaaacactccagggggcaagcccggggacatggccagcctggggatgttttcttacagttggtgtgtagaatgtgggggaatgatgctctcctggctccctccctcttcttctctactttctctctgcttccctctccctgcccaccacctcagcccaggctcaacttgcacatagacagcccttgaggtgcctgctcctcaagccgtctttgctcagccaacgggtcacgatctcggactcccagccagctctaccccaactggctgtggaacttgggcctctcacaagccttccccgctgcaagcccttggccagctgcctgcccttggaggctcttgaagtctcttcctcctcttcccactccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaaggtgaaggtgggggtggggcaggggcaggtggataccaggaggtccttaaccacaggcagaacaaggaattccaaggacggagttcaagaaaggaggccacttgggtgtcctggcccccacaatatggccttaactgtgttcatcccatggcaacctactgaggcaaggttttctccccatcttgcagataagaaaattgaggctcagagaagttcaggagctggcccccatcacatagcaagtgttgggtggaatagtactggttccctggcccacagcccaggctcctacttgcccaggggagaggaggacatacctagggccctgtcctggcctctggaggtgagggcataatacctgcaatggatgagctgcaggaggtgcatctaggaaaccaaactgtgtcagtctggtgcatgactctgaatgctgcttcaaggctacatacaagtgcttattaggtgcccgctgtggacccaacccatgctgagcactgccttttgggccaagatctttgtggccctcgtcctaagaatgcctgctggccctgacaaattgtcacctgagttcaaagtcagggtctcctggggtgagggctgggataagaggactgagtgagaaaaaaatagtttttcctttttttttttttttttttttgagatgcagttttgctctgtctcccaggctggagtgcaatggcgcaatctcggctcactgcaacctcctcctcctgggttcacgccattctcctgcctcagcctccctagtagctgggattacaggcacccgccaccacacccaactaattgtatttttagcagagacggggtttcaccatgttggccaggacggtctcgaactcctgacctcagtgatccacctgccttggcctcccaaagtgctgggattacaggcatgagccaccacactcggctgagaaaaacagtttttctattctctcactcaacaatcaacacagaagacttctgcaaccagaagtgtgggggtattttcccacacaccaggcactcaattaattctgcagtggaccctagccagtgtcccccaattctattctgacacaatctacctggagacagcatcagatcccacaggctgagtgctcagtcccacaagactttccctccacttcccatgccaaccacaagcctcaggctgttttaccaatgattctgactgaccagccgtatgctggggtttccacagccccatctttgagtttgctttatttgctagagtggctcacagagctcaggaaaacatctacttaatgtttatcggtttattataaaagatattacaaaggatacagatgaagtgatgcatacggtgaggtatgggggaggagctttcatgccctccctggctgcatcctgcagggacctccatgtgttcagctatccggaagctcgccaaagcttcattatgtaggcatgattgattaaatcactggatattggcagtcacctcaaccttcagcccctctccccttgctggaggttggggctgaaagtcctaaccctctaatcctgccttggtccctctggtgaccaagccccagcctgaagctactaggggctgctcaccatcaatcaactcattagcatacaaaaagacacttttcactttgaacattccaagaattttaggagtgtatgccgggaagaccaaatacacatctcacaatatcacagggacctcagagcaagataatttccattttccttctcctgggattattttattcactatctactttctaggaaattagaagggaaatggagcctcttgcaaataccagaagacatgtagatctagaacacaagctggcctgggagagaaaatagaggaatcagatgcccaacaggcagcctgactaaaaggagttgagaacacagcctcagggctgcgtggatacaggccctgaccgctgtcagccatgagatcttggccaagttattgaatctgtctaagtgtcagtctccttatctgtaaaatggggctaatgtacacctcgctcataggagtgatgtggggttgcagggcagagttactgagcccgtagtaagcgctccataaatgccagccactggtgttgtctggcaggagctggcgttacagtggttggggatgctggggaagtgtctgactgtcccagctccaggtcttgccaactgtaggagtaaggggagaatttgatgggaccagtgggtggaggaagaggagtgatgtctgtgaccagaaacatacagaggtcagcacaggaccctgatggtcagtgggtgtgttgtcttgtatatgggaccaggctctgcaggttgaaaaaggatggggtacgtccctgagcccccagcctagatcatcagatgggagagaggctggctctgggtggtgggagagaagggcataataagaacccttcaacgttgatgcatggcccttgggggctggaacccctccaacctcatgttgcccatgtctctgcttgttagaggagtgaagaaagaagacaagactttggctgtgggcatccagttcatgttcctgaggattttgggtaaagatcttgcttgggaccattggtggtggtgatggggtccagatgcccactgtgtgccaggcctggggcacaggcatgagcggaattcaatccctgatcttagggctcacaagctcatggggtgacagacctggcccagctctcctagagcggggtatagaggcagagtctagacagcccgtcaggaagccacctcggatgcaggggtggggcgggcttgagggccagacagccaagaggccccagtaacccagagcccctgaggggttgtacatgccagggagggggcagggtaggacggtgggccttcattgtcccctgagcaccacctccctcagcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatcttta

SEQ ID NO: 19837 - DNA, 2874 bp, Homo sapiens
  ENST00000341411
cgtcgagctgtctgtcgctactacaataatgacctgctccgaaaccggtgagacctggtttgatggcttgtgggaagggtgctggaaatactctcagagtcccaggcaggataccagcagggaggggaggtttcatttaagtctacctgctaggtgacaggtgtcattatatattcagtgctgagctcaccagtccttcaagctaaacactgcccccctccttttatagatgaggaaagtgacagttaaagcaagtagcccaaggtcacacagctaataacttgcagagctgggccttgaccacagagtctatgcaggaacttggggagaaacagaggagcagccatgctgcgagagggacttggggtgaagggctggggagaaagccctgtctaggacacaggaggcctgggtttcaggcccagctctgtctccctcatcatgggacttatcttgtctggggctcagtcttcccatctgtacaaaggggaactcaaaggaacctgaaggcacagaggcggctggcctgggatggatgtggagaggacttgctagcagggctggggacagggagctggtcactttcagctctgaggaggtgaggagggcacagtttctgtgggctgggactgtccacagggggcttcctagaaaaggaaaagtcaaacaagggctttgatagttaaacaggggagagggaatccgtttgttcttgtggcaggtggcgcaatataaaattgcacttgtcaggccccctgagcccttgggctcggagagaggcagggccaggccaggccacagagcagagtccaggacagggcgatgaagatggccaggcctctgctcccacccagggctcctctgcagagcctctccccctcctccagggaagagccacagcagaggtcaatgtctccctgaggcctcagtatctctgatttcacaatgagtgatgactgctgacgtccatgccctggcctggcagctcttgagttcaagggtccccattctttccccaggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataa

SEQ ID NO: 19838 - DNA, 3092 bp, Homo sapiens
  ENST00000497209
gcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgagtggagccgctgcctaccgcccctgtcctcccctggaccctgggaaggggcccccgtgccttccccttgtaatcggagctattgttgggcttcccaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacggtaagctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccacttgggggggggtgatgatgtggctggggactggtccaggaggccactggcctagggggtgacttggcatgcaaccccacttctgtgggtgctgacgctgtggttttctattgcagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 19839 - DNA, 2665 bp, Homo sapiens
  ENST00000370507
gacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 19840 - DNA, 986 bp, Homo sapiens
  ENST00000470412
ttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagtttcagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaactttggaagaaggcaaggtcagaacttattctgcagggagctttggggatattggatactaaggcccaagccctctgtgatacgcctttcgctttggcataaaataacggttgactctc

SEQ ID NO: 19841 - DNA, 543 bp, Homo sapiens
  ENST00000495889
gaactagggaaaggggctgtgcatcaggcggacggtgctggggggcatgggtgtgccttccttgcgtgaggaggaaaaaccattctatcaccagaaggcagtgcccagtggtgccctgcagccacggagacgaatgtggacggccagaagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggctcccctgctgaggattcatcccaccttggatggaaaatgcagtttttgtgggagatggaactggagggtacggagggctgactgcacatacaaatatacatacatgagtgtacatatgttcttatataaacgtgtcacagtaaaattgtt

SEQ ID NO: 19842 - DNA, 819 bp, Homo sapiens
  ENST00000466961
gcagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatc

SEQ ID NO: 19843 - DNA, 856 bp, Homo sapiens
  ENST00000451793
actacagccctgtgtgcggctcggacggcctcatgtacttctcactgtgccacgcagggtgccctgcagccacggagacgaatgtggacggccagaagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 19844 - DNA, 440 bp, Homo sapiens
  ENST00000497919
gtgacttggcatgcaaccccacttctgtgggtgctgacgctgtggttttctattgcagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagtttcagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaactttggaagaaggca

SEQ ID NO: 19845 - DNA, 556 bp, Homo sapiens
  ENST00000466818
tgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggaagaagagaatgaatttagaaggctgtaaaccccatctgagccttacacatagatctccttgaattggattttcaccaaggccgtgatggatgtggagtctcggctttctgacaacgtcttccagagcaggctttctctagagggtggactgcctgtgttctcctgggagagaatgcatttgcttccgatgcccagggcacgaaagaggtggacgaaacaacggaagtggagggggtggattctctacctgggaaacccagcatggcacactcatatagaattaagatcttataataagtgtgcagatgcgcccgttctaaggaaataaagggttctgccctcc

SEQ ID NO: 19846 - DNA, 2776 bp, Homo sapiens
  ENST00000217159
ctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctgcg

SEQ ID NO: 19847 - DNA, 5334 bp, Homo sapiens
  ENST00000310954
cccacgccgcgccttccggttggtccttgaggcgacgggtgaggcacagctgagcgccaaagccacaggctggggcgctaacgcccccgctcagcgctctgcgctccagacagctgcgagctggagtaggaaggttcaggcggtggcggagagtgcgctggaggctggagggccaggaggcgggaagcttcccgcacgggggcgctgtcacctgcctgtgggaggagccagagagggacctggctctgctgctctgaagcaccggagtcgggagaacccatccagacatgaagagcgccaaaggtattgagaacttggcttttgtcccctccagcccagacatcctgcgccgcttgtctgcgtcgccctcccaaatcgaagtctctgccttgtcctctgacccccaaagagagaattctcagccacaggagcttcagaagccccaggagccccagaagtcaccagagccatctctgccttcagcccctcccaatgtctccgaagagaagctccggtcactgtcgctgtccgagtttgaggaggggtcttacggctggaggaacttccatcctcaatgtctccagcgctgcaacacacctggaggctttctgcttcactactgcctcttggccgtcacgcaaggtattgtagttaatggcctagtaaatattagcatttccactgttgagaagcgttatgaaatgaagagttccctgactggcctgatttcatcaagctacgatatttcattctgtttgttgtctttatttgtatcattctttggtgaaagaggacataagccgagatggcttgcatttgcagcctttatgattggactgggagcacttgtattctcattgccacaatttttcagtggagaatataaattggggtctctttttgaagacacttgtgtaacaacaaggaatagcaccagttgtacatcttcaacttcttcactttctaactacttgtatgtcttcatcttgggacaactattgctgggggcaggaggaactcctctttatactctgggaacagcctttcttgatgattctgtgcccacacacaagtcttctctctatataggaaccggttatgctatgtcaatcttaggccctgctattggctatgtattgggaggacaactgctaaccatatacattgatgttgctatgggagaaagcactgatgtcactgaggatgatccgcgatggttgggagcttggtggattgggtttcttctatcatggatctttgcttggtctttaataatacctttttcttgctttccaaaacatttaccaggtacagcagaaattcaagctggaaaaacttcccaggctcatcagagtaatagtaatgcagatgtgaaatttggaaaaagtattaaagattttccagctgctctaaagaatttgatgaagaatgctgtctttatgtgtttagttctatcaacttcttcagaagccttaattactactggatttgctacatttttacctaaatttatagaaaatcaattcggattgacatccagcttcgcagctactcttggaggggctgttttaattcctggagctgctctcggtcaaattttaggtggcttccttgtttcaaaattcagaatgacatgtaaaaacacaatgaagtttgcactgttcacatctggagttgcacttacgctgagttttgtatttatgtatgccaaatgtgaaaatgagccatttgctggtgtatctgaatcatataatgggactggagaattgggaaacttgatagccccttgtaatgccaattgtaactgttcgcgatcatattattatcctgtctgtggagatggagtccaatatttttctccctgctttgcaggctgttcaaacccagttgcacacaggaagccaaaggtatattacaactgttcctgtattgaaaggaaaacagaaataacatccactgcagaaacttttggttttgaagctaaagctggaaaatgtgaaactcattgtgcgaaactgcccatattcctttgcattttctttattgtaattatttttacctttatggccggtactcctataactgtgtctatcctaaggtgtgttaatcacagacaacggtccctagccttgggaatacaatttatggtccttcgattattagggacaattcctggaccaattatatttggtttcacaatagacagcacatgtattctttgggatataaatgattgtggaattaaaggagcttgctggatttatgataacatcaagatggcccatatgctagtagccataagtgttacttgtaaagttatcaccatgttcttcaatggatttgcaatctttttgtataaaccacctccatcagccacagatgtgtcatttcataaagagaatgcagttgtgactaatgttttagcagaacaggatctcaacaaaatagtaaaagaagggtgaaatgggaaaagagaagactgttttacacctggaaaatttacctcgatttttaagaacacacattgccatggcaggattatctatccaatatggacaatcatatttacaaaattgatgtttttataatcaaatgtatttttttacttatgtagtttttgttttatgcaagaaacagacctgtgccttcaaagcccacgtaaagcctcaaaacacagcacacacacacacgagcacacacacacacacacacacgaacacacacacacacacacacacgcacacatacacacttatttcctattcccattgtctaggtatgaaatcctcaagcaataacaagaaaaaaggcccacaattagaaaaatttacatttaaaaaaaatgttgtttctatccccattacaacttgtttaattttaattttcattgtcaatattttgagcttagaacatttatggtataaaaatttaaactaatcaaagttgtgtgatgatttccgggaattattattgaaagcctatgaatttaaaaccaggtttaccatgtaatttgtttttaaatttatgtatactagcctggcctttctccaagcaaattattgaactattagaatatgttagttatcatccttgtgtcttagtatatagtgaatacagaaacatcagcattgtatacacatattttcactttaactcaagaattccaggaggtaatttgttgatattacaatttttaacacatttatgattctgtgataatattattcaattgcatatatttcagaggaaagtaccagtcagtaaagaaaaatgccaactaaacatgaaactattgatcaatacttatatacctttaatttttcctatttgaaaagccaaccacttaacacattactcatagcacctaagacagtgccttgcatagtgtagtcatctattattattgtttaattagaatattaaaccctaccctttaactcagcagtccccaaccttttttgcatcagggaccatttttgtggaagacaatttttccatgggggaagaaggtatggttttgagatgaaactgctccacctcagaccatcaggcattagttagattctcataaggagagtgcaacctagatcccttgcatgtgcagttcccaatggagtgtgcactcctatgagaatctaatgccactactgatctaacaagaggtggagctcaggcagtaatgctcactcacctgcctctcagctcaccaactgtgtggcccgattcctaacaggccacacacagcccagggctggggacccctgctttaactgatgcattgatttgataaagtattttacaagcctgataatgttataaccctgtttattcaggtcagatttatgccaactttgctgagaatatggagggtatagatgagtgaacatcaacaaacataacttctaccatggttaagaattttacttaggaaaagtattgaagttcaaatccagatagtattacatttgaaattgttataagggttattaatttaataaaattcatcatcaggtttcccctataagctttctcctaggttaattttccacaagcattgttttatatacactgtaatcaggataacacaagcttagtgttagatcttgtaggaaaccaagattagaaacattagaaatttgcagaatttaagaaattatgttttgtggtaatctatggccaacgatgttagaacctagcgcaattgtaaagtgaaattcaaggagaaggaatgaggagttagggaagcagcatacttgaatattagagaaggagaggagctgtgggtcaggaatcagagagacctgctaaaaccagacagatataaacaccaaagacggaagccaaataggtagccaaaaatccagatatttgagaagcaggaaatttatagcaaccaaagaaatagggcaagagaggcaggtgaacacacatgatacctcaattgacaatcttcctcccaccaagccagacacgttgtaaatgctgcttcctattggagcccagaaaaaaggaaaaggaaagtttaggctttctttgtcctttgtgtggaagcagggaattggattgaagactttcatagttgtaacataaaggcaaatcctgaggaactcactgatggagatgtgaaatggcagtaaggaagaaaacagaataactgaacaaatatattagtctagggccacttaatttagaggaagaaaaaaaatcaacccatccatagaaatagtttgataaacaggtcactaaatcattggcgtttataaagattcttagctatcaagggctgcattgtattttatatactcagttttataaggtgatactttttaaataagcgctttaatgaaaatggttagactgaaaataattttggtccttaaaaggagtcaggagcttttatatataaggtacatattttaaaagaatacctcctttataacagggttttacagacactaccataatttataatcattattttttacttttgggttcacctagatcatatgagttgatgtgatacttctagaacaaaattattcatagtgcgttttttgtaatttatgattgttaagtaagcttgacttataaattgacattgtaattgtgtacataattggatatatgtgttaaaatttaacatttagatttacttaattgtagaaaatacaaatgtaaaacttacacatggaaagaactgtatgcagttgactttactatgtaaattggagggaaacaaagttttagatccattttctttcaaaattttctttattgtaaagtatgcaaaatatatattcataccatttattaaatcagaatgtttatacaaaa

SEQ ID NO: 19848 - DNA, 553 bp, Homo sapiens
  ENST00000589562
tataatctattggctttgacaataaagtttatggggcagagaaaatatttaactttgaaatccctgtacatcgaaaggaatattttacaaataacttgacaaagatgtttcaatggtcttggaatgcagaatggaattttgagaaatagaaatttgtaggcaagggtctaaactaggcaaggtggtaagaatgtggatgtgccagccttcttttttttttttttgagacagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcga

SEQ ID NO: 19849 - DNA, 575 bp, Homo sapiens
  ENST00000588579
aaacgctaagggggcttcggaagcgctggagcttgagaggtttctgtatacatagccttcaggactgcttttggtggaaagagatagcaggtggtgctaattcactgtgttggtgggaactctggctacactgaaaggtttgaaaaagttatcctgtaaactgactagaatcaggtgcttttgtttctgaagtgcttttattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtct

SEQ ID NO: 19850 - DNA, 714 bp, Homo sapiens
  ENST00000427966
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaaggtttgaaaaagttatcctgtaaactgactagaatcaggtgcttttgtttctgaagtgcttttattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgc

SEQ ID NO: 19851 - DNA, 606 bp, Homo sapiens
  ENST00000430814
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgca

SEQ ID NO: 19852 - DNA, 584 bp, Homo sapiens
  ENST00000589811
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaa

SEQ ID NO: 19853 - DNA, 791 bp, Homo sapiens
  ENST00000441608
atctcctgcgtgggatgtgcgtgggatggcgccaacccgctagtatataaggactcgacctgggcgcctccagggaaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcag

SEQ ID NO: 19854 - DNA, 634 bp, Homo sapiens
  ENST00000591682
ggaaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccc

SEQ ID NO: 19855 - DNA, 5030 bp, Homo sapiens
  ENST00000394566
aaacgctaagggggcttcggaagcgctggagcttgagaggtttctgtatacatagccttcaggactgcttttggtggaaagagatagcaggtggtgctaattcactgtgttggtgggaactctggctacactgaaagattcttactttgacccccaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagtcccaccaggatatttgcgatatactccagagtcactctggagggacctgatctcagagcacagaggactagaggagttaataaataagcaaatgcaacctttctttcggggaattttgatcttctctagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaatatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 19856 - DNA, 1124 bp, Homo sapiens
  ENST00000592108
atatctgccgagcagagacccggaaaactttcctaagagaaaactttgaacacattcaacacatcgtcattgacgaagctcagaatttccgtactgaagatggggactggtatgggaaggcaaaaagcatcactcggagagcaaaggaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattg

SEQ ID NO: 19857 - DNA, 579 bp, Homo sapiens
  ENST00000586099
gaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatggatcttctacagttgtctgaagattttgaatgtcagctgagtctatctagtgggcctccccttagcagaccagtgtactccaagaaaggcctggaacataaaaaggaactccagcaacttttattttcaggtaattatggtttgtcttctcaacaccagccagtttctatattaggataaagggagattaaactataatatttgttttgtaaaatcctgaaagtgctctgcaaacccatttgtaagacgtgatgatgttacaatcctattggtgataagtggtttagaaatgaacccttactgaccccactggctaaggcaggaccacacatagaatccaggaacattatttcc

SEQ ID NO: 19858 - DNA, 4910 bp, Homo sapiens
  ENST00000308377
gcttcggaagcgctggagcttgagaggtcagagagggtccttgcccccagcctgggactccggagttgcgtttctacccgtgcttcagggtctagcccagccgaatccgcgtcgggctgtaactcgagtgccagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccagatcttctacagttgtctgaagattttgaatgtcagctgagtctatctagtgggcctccccttagcagaccagtgtactccaagaaaggcctggaacataaaaaggaactccagcaacttttattttcagtcccaccaggatatttgcgatatactccagagtcactctggagggacctgatctcagagcacagaggactagaggagttaataaataagcaaatgcaacctttctttcggggaattttgatcttctctagaagttgggctgtggacctgaacttgcaggagaagccaggagtcatctgtgatgctctgctgatagcacagaacagcacccccattctctacaccattctcagggagcaagatgcagagggccaggactactgcactcgcaccgcctttactttgaagcagaagctagtgaacatggggggctacaccgggaaggtgtgtgtcagggccaaggtcctctgcctgagtcctgagagcagcgcagaggccttggaggctgcagtgtctccgatggattaccctgcgtcctatagccttgcaggcacccagcacatggaagccctgctgcagtccctcgtgattgtcttactcggcttcaggtctctcttgagtgaccagctcggctgtgaggttttaaatctgctcacagcccagcagtatgagatattctccagaagcctccgcaagaacagagagttgtttgtccacggcttacctggctcagggaagaccatcatggccatgaagatcatggagaagatcaggaatgtgtttcactgtgaggcacacagaattctctacgtttgtgaaaaccagcctctgaggaactttatcagtgatagaaatatctgccgagcagagacccggaaaactttcctaagagaaaactttgaacacattcaacacatcgtcattgacgaagctcagaatttccgtactgaagatggggactggtatgggaaggcaaaaagcatcactcggagagcaaagggtggcccaggaattctctggatctttctggattactttcagaccagccacttggattgcagtggcctccctcctctctcagaccaatatccaagagaagagctcaccagaatagttcgcaatgcagatccaatagccaagtacttacaaaaagaaatgcaagtaattagaagtaatccttcatttaacatccccactgggtgcctcgaggtatttcctgaagccgaatggtcccagggtgttcagggaaccttacgaattaagaaatacttgactgtggagcaaataatgacctgtgtggcagacacgtgcaggcgcttctttgataggggctattctccaaaggatgttgctgtgcttgtcagcaccgcaaaagaagtggagcactataagtatgagctcttgaaagcaatgaggaagaaaagggtggtgcagctcagtgatgcatgtgatatgttgggtgatcacattgtgttggacagtgttcggcgattctcaggcctggaaaggagcatagtgtttgggatccatccaaggacagctgacccagctatcttacccaatgttctgatctgtctggcttccagggcaaaacaacacctgtatatttttccgtggggtggccattaggaagaactccaaatcaaaatgctatgtaaatgtctatgggtgacagtctgctgatggtagaaacctttctttttagttcacaagtcagagatttggacggagctgacacaaagagtttggagctcccccatttctggctctcctttcaggggttccttccccaaccctttcagcagcggtggctgccccccattctgacccctgactcttccagccagaaagatggtggttttctaaaggaactttagctgtcctgcacaatgccgatctgtgtcttgcattttgggtaaaagccataaaaataagaaactcagcctgtggcctttctttcttccaaggctgggcttctttttttaagtgacttcatgcagtttgttgcttttaaaaatttgtccagaatcgttttctgcagaagcatggtctgttaggagcttactggccgtagcagaagcaattgtttcctgaattcttgacatttatctttgctgtattcatttagggcttgggagagtccgaagataattcagtcactgtcagattaataattttgtcaggacaaagaataccgttatgattatttaatcctttaaaattgtggtctccagagcttgttctcagaatggcccagaccaagccttaattgtgatagtgaatattaatggtcactttaaggagaaattataggccaagatgaaatgaacataaacctgtttgccctggctttcagtggaagatgatattagagaccaaaatctggttctgaaggtgtgtatcagccctaaggtgaaccagacttgggaaagattgtctttaaaaatcaatgagtttatgttttaacttctcagcttagttctatgcattgctctataacacacctagttaagttttatgttattcttgaactgtgattttttttctatttactttcatggtttggtgggccattgttatggactgaatgtttgtgtcccacccttcacccccaaattcccgtgttgaagccccaacctgcactgtggagctggggctgctaaggaagtaattaaggttacatgaagtcatggtggggctctgatctgctaaggttggtgtccttatagggagagaccccagagagcttgttccctccctccctgtgcatgcaaacaagagggcatgggagcacacagagagatggcagccacctacaagccaagaggagaagcctcacaatcaaactctcgctgctggcgagagtcttggactctgtcttggacttccagcctccagactgtgagaaacaaatttctgttgtttcagcttctcagtctctggtgttttgttattgcagcctgagaacacagctgtacgattatttgtcaaacagaaaacactgatacttaacaatgctaatgcaattatttatttgcttttcagtctctacaaaacgttctaaaacactaatctaaatattaacagtaaaatatttgcataactaatggaaactaagaaatcatatgaccaatatttcacttattggtaatcttactctactgatttccccccagactgtgatttttgaacttccttgcctttctcctgtctttctgtgtttattcatggaattccagttatctgggcttgaaattgcaggctctcctaacttaagcaaaatctgacagatcagcaaaatgagataaatgtttcttttttctttctgactgcattaaatcagatacaactcagcattaaaaagctatctttgtaaatgttgttactaataaattagtcttataagatccctggactttggagttgttgcaatgtctttgagagtaattctttaaaagtctaatttcgactggttgtatctctttatgatttattgccccactaacaatatttgaaacaatataatattttaaaatgtataaataattatgaatttttgtttagaacaaagaggattactgatatttgtttccctatgaatggcaaaaggtttagcttactactgcatttctgttttaaataaaaagttgagagtttgtgtctcattaaactgaaaaaaa

SEQ ID NO: 19859 - DNA, 582 bp, Homo sapiens
  ENST00000498396
aaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaaggtttgaaaaagttatcctgtaaactgactagaatcaggtgcttttgtttctgaagtgcttttgtaagtgtactgagtttcttttctgaattcttaatttcttattgacttagtttaattttatttaggatttcaaatttatatgggacaatatctctaccttacaaaaaatgtgcaagtgatgctgattataattcctttaatcctaaggaaagagcttgagatagagctccctaagccttttttgcctgcaaaagaatctaagcagatggtggggttgctgtttaaatacaattgccaaccaaaaactataatctattggctttgacaataaagtt

SEQ ID NO: 19860 - DNA, 588 bp, Homo sapiens
  ENST00000592122
tcttgcatctcctgcgtgggatgtgcgtgggatggcgccaacccgctagtatataaggactcgacctgggcgcctccagggaaacgctaagggggcttcggaagcgctggagcttgagaggtcagagagggtccttgcccccagcctgggactccggagttgcgtttctacccgtgcttcagggtctagcccagccgaatccgcgtcgggctgtaactcgagtgccaggtttctgtatacatagccttcaggactgcttttggtggaaagagatagcaggtggtgctaattcactgtgttggtgggaactctggctacactgaaaggctggagtgcagtggcacgatcttggttcaccacaatctcgtctcgaaggctcaggtgattctctcacctcagccgcctgagtagctgggaccacagtttcagctgtgagttcaacatggaggcaaatcagtgccccctggttgtggaaccatcttacccagacctggtcatcaatgtaggagaagtgactcttggagaagaaaacagaaaaaagctgcagaaaattcagagagaccaagagaaggagagagttatgcgggc

SEQ ID NO: 19861 - DNA, 5233 bp, Homo sapiens
  ENST00000503823
tgccccgcgcgctctgctacgggcccgctgggcttccgcgccttctagcttccggagcccactttgatcggggccataatacctattgagatcccctcttctgtcttgtaccttcgccactggcatcggatttgcagaagcgtgcgtgggatcagaggaccgccctccccacaacaaccggcccctgcatcttagcagccgttggaagccccagctcttttaccgccaagttcatccttgggagacagaagacgcgtgatctcctctccgctgctcttggggtctccttgcagccctggccaggcggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaac

SEQ ID NO: 19862 - DNA, 6390 bp, Homo sapiens
  ENST00000504154
cggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttgtaacatgctgaagacaagcagaagcacatgcacgagggacagaggagctactgtgcactgctgtgaaattgcccagagcataaaacctgtgtaccctccttcacatcaaccaagttcactaggacataccaagcacatgcgtgtgaatgaggatgcaaggcaagagaatggaactccagaattcacagatagaacaaatggatgagaaatatttcatgcaaaatataaagtgtcctgaggatctgggttccatttacgagaggaaatgaaagtgctaaaataaattttatcttccttttaaatgtcagcatgtcagcagaagcagcacacaaaagtctttaccattttccagtattaatttttttgtaatataaatgataaaggagatgataaagaaccaatagattattgataaataaattagtaataatatgattttttgtttctatgagttctaaacagccctatacagtattcagtttccatgagaaatatttattgtatcaaagtacattgtacttaacattttaggccatccttttactgttccttgatgctttaatatatattaatttataattatcctgatatttttgtacatttttcaaacttaaaaatcaggatttttttttttttttttttggcaatagtactaacatagggttttatcttgggatacatatgtattggtctgtttgttgaccttgacatctgatcactgatgtcaatgacctactggcctcattcaggacacctgcagagagtatgcaaagtccgagagaggaaaacagaaatctgtatgtgagatggtcattgtacagaaagaagtggcccctctgcaacatgtcctcacagaaacgaaatggtgtgtagcaatcaacactagaaagtagaccttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttca

SEQ ID NO: 19863 - DNA, 5132 bp, Homo sapiens
  ENST00000273739
gcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtgatgaggaagaaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcagctaaagaacagtatttcattccaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacagctgctaatctgaatgaggtggaaaaaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttg

SEQ ID NO: 19864 - DNA, 4752 bp, Homo sapiens
  ENST00000503837
atgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtgatgaggaagaaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaa

SEQ ID NO: 19865 - DNA, 532 bp, Homo sapiens
  ENST00000508824
tttgcgagtctctaatgaagaagtaaatgcagacccggtgttgacggcccacgcgctcctgatgaggcgcttccagagttcagcgaagtggagcatggaggccgttctctttgtgaacgccgaggccgccgccccgcgccagtccggccgccctagggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataac

SEQ ID NO: 19866 - DNA, 443 bp, Homo sapiens
  ENST00000509099
attgtccctttgtcttgatggtgtaaggaagtggaatcttttcagagccctggcagtgctgggcagtgaaaagttggaaaacttggatcattagaagaaaattatcaactatgtttcaattcccaccttgttagaaattatttaaaacctttgttccaacaatttttatttagaaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactct

SEQ ID NO: 19867 - DNA, 712 bp, Homo sapiens
  ENST00000509394
gaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctttctagtgtacatgtgcacaacgtgcaggtttgtttgtgccttgtcttttaccccctagatcataaagagctctgctttttcacttttcccacttcctcccctgtcacatcaaggacttaaatgttgatagagatgagatcaaatgactaaaaaacatcattttgctcatttttaatttggaagggtttgaatctgacatacatatgcaggtaacattcactacattctgattcttaaacggggcattaaaacttccacagtatcgagtattatgattctacacatatatttca

SEQ ID NO: 19868 - DNA, 767 bp, Homo sapiens
  ENST00000511508
acagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaagggctgccagggccctgtggcttcctcataccaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatga

SEQ ID NO: 19869 - DNA, 739 bp, Homo sapiens
  ENST00000509941
atccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtacaaataataggaaatattttgccttccatcagtatatctgtttgaaagcatcattggaactatgttatatatgtttagtaaatctttttttatttgataaatggtaggtgtcttgaaaatcagatgtaatgtaaataacataaggacttaaagatagtttcagctaaccaaataaaagacccaggaatctctgttcaaacatacgcatctattataaagccatgctatccagtaataaaagaagctattttgctaaa

SEQ ID NO: 19870 - DNA, 394 bp, Homo sapiens
  ENST00000512993
ccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttcattaa

SEQ ID NO: 19871 - DNA, 2947 bp, Homo sapiens
  ENST00000508541
ctgattttatgatagcctattgaaactcaaatatacgtatgatgtctaaacattttcatttacaaattactctagtcaaagctgggctttttctaattgttagctttggaacaaaaaggaacagatttactaattgtttctctgtgctgtggaactttgccaatctgtatttattcttgacatgtgcacatatgtgtgttgtgcctatatcaaaatgagctattaaaaatagttttggaagaagttcatttttaaccactgaaaaaaggaccataaatatgtggtcattaaagtccttatgatggatggatatggttaaattagaaaaacttaccccagggcaaggaattttctgtcaccagtcctttcctggaaatggtaagtttcatccttttgaccctgctctagaaagcaacccacagcgagatggacatagactaaaggcctgtactcacagaacttcacagccaagagacttcattcaatacctgtcagagtgtaaccatggactacccaaatcacctgagctgcatgtagatatttagatttctgcacctctcctgttcctacaggatcagaacctcagaaggaggggagagaggagcctgtaaagctgcctttgagcatgcactgctgttggttcttatgtatgacaaacttaggacaacttctctggtccatatgctcatggtgtatagatgacaatactaagccccagagagaagaaataactgctccaagtgcacgcagaaccagaaatccttaccgtataacctagtggtttcgtacacctagctgtctgactgatgcctgctttgaatgccaatggatgagtcatttcctatgaatgggaaaggagaaggtggcataagttcagacccagagtgtgctacagttcttggtctttagaaccaacagaccccctgaagagtgagaaactgggtcttcctcagcctagaacttccagccagtagtccagagtttaggcacagctaaagcataattacggggttgtggggatgtggtggtatagccagcactctgaaagcttccagcaccctccccccttccctggatgggtgccttctgcaggatgccttccacggactaagggtctggcttaggccatggaaagattcttccgttttgccaaaatgagtgttaccagataactgtcactagtggaatgtatatatacaaagattgcaaatactctgtttttgaagggatttcatttttatttctgatttcttggactatgaagtcttcactcttaattagcaagaaagaaaaaatgatgtgaatgaggtgctgtcctgaaaagaatcaggagtgagtttttaggcattgacatcattgaccaagcttagggacgttgccaggagtgagctgaattagttgctaacttcgaatgtgggagggctggggtgaatggtcactgtgaaccccagctgtcagcccctgaaacctggtggacctaaccctgactccagagatagaggagttcttctcatcagcctaactctaacctgaactcactgggtcaccttgagcatgtcaccagggctttctgagccctagccccttgtctttaagataaggggtagaattagagcaccataaactgagctttatggagctccagacttccaggagtgtgtgcctggaggtggagggtggaggacaaacagagagggaacattcccttcccccagtcttgcctttaaggacagtagctctgcctctaggttttatatatttgtgtacatgtaaagttttctttgaagcaaattttaaagattaaccaccaatcaactaggtattttattctagttgtggattagaatttcctggagcatcttccaatacagaacaaaacaaaaacacacatctctacatctcttctccacttcacttccctaccaccctgcccaaatatcctgccataataggttggcagtgaggtcccaagcatcagtatttctgagtagcaaatggctcagaaatccccagagagcctgacctctgacctggtgttcctccccaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttgg

SEQ ID NO: 19872 - DNA, 6380 bp, Homo sapiens
  ENST00000622093
cggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactggatttaaatggaaataacatcacaagaattacgaagacagattttgctggtcttagacatctaagagttcttcagcttatggagaataagattagcaccattgaaagaggagcattccaggatcttaaagaactagagagactgcgtttaaacagaaatcaccttcagctgtttcctgagttgctgtttcttgggactgcgaagctatacaggcttgatctcagtgaaaaccaaattcaggcaatcccaaggaaagctttccgtggggcagttgacataaaaaatttgcaactggattacaaccagatcagctgtattgaagatggggcattcagggctctccgggacctggaagtgctcactctcaacaataacaacattactagactttctgtggcaagtttcaaccatatgcctaaacttaggacttttcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtgccaggcatggtggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatacgtttggaacagaacacaatcaaagtcatccctcctggagctttctcaccatataaaaagcttagacgaattgacctgagcaataatcagatctctgaacttgcaccagatgctttccaaggactacgctctctgaattcacttgtcctctatggaaataaaatcacagaactccccaaaagtttatttgaaggactgttttccttacagctcctattattgaatgccaacaagataaactgccttcgggtagatgcttttcaggatctccacaacttgaaccttctctccctatatgacaacaagcttcagaccatcgccaaggggaccttttcacctcttcgggccattcaaactatgcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgcgtctcaataataatgaatttaccgtgttggaagccacaggaatctttaagaaacttcctcaattacgtaaaataaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgatgttgagaagcaatcgaataacctgtgtggggaatgacagtttcataggactcagttctgtgcgtttgctttctttgtatgataatcaaattactacagttgcaccaggggcatttgatactctccattctttatctactctaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggaaatgatgacaatagttgctccccactttctcgctgtcctactgaatgtacttgcttggatacagtcgtccgatgtagcaacaagggtttgaaggtcttgccgaaaggtattccaagagatgtcacagagttgtatctggatggaaaccaatttacactggttcccaaggaactctccaactacaaacatttaacacttatagacttaagtaacaacagaataagcacgctttctaatcagagcttcagcaacatgacccagctcctcaccttaattcttagttacaaccgtctgagatgtattcctcctcgcacctttgatggattaaagtctcttcgattactttctctacatggaaatgacatttctgttgtgcctgaaggtgctttcaatgatctttctgcattatcacatctagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtcctgtggatgtcaatattctagctaagtgtaacccctgcctatcaaatccgtgtaaaaatgatggcacatgtaatagtgatccagttgacttttaccgatgcacctgtccatatggtttcaaggggcaggactgtgatgtcccaattcatgcctgcatcagtaacccatgtaaacatggaggaacttgccacttaaaggaaggagaagaagatggattctggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtgagttgtgtgaggagaagctggacttctgtgcccaggacctgaacccctgccagcacgattcaaagtgcatcctaactccaaagggattcaaatgtgactgcacaccagggtacgtaggtgaacactgcgacatcgattttgacgactgccaagacaacaagtgtaaaaacggagcccactgcacagatgcagtgaacggctatacgtgcatatgccccgaaggttacagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcagattgccacagatgaagacagcggaatcctcctgtataagggtgacaaagaccatatcgcggtagaactctatcgggggcgtgttcgtgccagctatgacaccggctctcatccagcttctgccatttacagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataaatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttgtaacatgctgaagacaagcagaagcacatgcacgagggacagaggagctactgtgcactgctgtgaaattgcccagagcataaaacctgtgtaccctccttcacatcaaccaagttcactaggacataccaagcacatgcgtgtgaatgaggatgcaaggcaagagaatggaactccagaattcacagatagaacaaatggatgagaaatatttcatgcaaaatataaagtgtcctgaggatctgggttccatttacgagaggaaatgaaagtgctaaaataaattttatcttccttttaaatgtcagcatgtcagcagaagcagcacacaaaagtctttaccattttccagtattaatttttttgtaatataaatgataaaggagatgataaagaaccaatagattattgataaataaattagtaataatatgattttttgtttctatgagttctaaacagccctatacagtattcagtttccatgagaaatatttattgtatcaaagtacattgtacttaacattttaggccatccttttactgttccttgatgctttaatatatattaatttataattatcctgatatttttgtacatttttcaaacttaaaaatcaggatttttttttttttttttttggcaatagtactaacatagggttttatcttgggatacatatgtattggtctgtttgttgaccttgacatctgatcactgatgtcaatgacctactggcctcattcaggacacctgcagagagtatgcaaagtccgagagaggaaaacagaaatctgtatgtgagatggtcattgtacagaaagaagtggcccctctgcaacatgtcctcacagaaacgaaatggtgtgtagcaatcaacactagaaagtagaccttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttcatt

SEQ ID NO: 19873 - DNA, 9706 bp, Homo sapiens
  ENST00000519560
gagagcgagcgccggccagctcacccggccgccccgtgccccagccgcagccgccgcgctccccagcccagccccaagccggacctccccgggcgccacgccccattgcgctcgccccaggtccccaacccggcccgcgggccagcggggccagggggcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgaggcaactggaagaaggaaggaaggaaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccgcagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactca

SEQ ID NO: 19874 - DNA, 4895 bp, Homo sapiens
  ENST00000332966
cgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagtactctggttttgctgcccagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgta

SEQ ID NO: 19875 - DNA, 594 bp, Homo sapiens
  ENST00000518092
ctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtggccactgacaaggacaacggcatccttctctacaaaggagacaatgaccccctggcactggagctgtaccagggccacgtgcggctggtctatgacagcctgagttcccctccaaccacagtgtacag

SEQ ID NO: 19876 - DNA, 4228 bp, Homo sapiens
  ENST00000519486
ctggagtgcatttttaatctacaccctcgtgaggtttgagaagcactggtcaagagtcatcccagtgcccagaatcagttctaggagcagctgctgtggctagggacagggtcatgcatggaggtcagtgggcagctggagccatctcccatctgccttccagctcaatgccctgcattgtgcctccatcacaacaaaatagcagagggggccttgagctgataggagacttgagatgcttgctctgtgcccaaatggctgtgtccagtcacttatggctccaggtacttcacctctcagggctgctgtttccttcttgcagaattaagaattaagacgcagtttgccaaatgttctcacttatacatggaatctaaacaaagccaaactcttagaagcagaaagtagaatggtgatgttcagaggccggtggggtgagggtggggtagagatgaagatgacacagatgttcgtcaaagggtgcaaaatttcaggtagacaggagaagtaagttcaagagatccattgtgttatacaacacggtgaatgtagttaacaacaatgtatcgtatacttgaaaatagctcagagagtagattttaagtgttcttaccacaaataaatgataagcatgtgaggtaatgcataggttaagtagcttgacttagctattccacaatgaaagcatatatcaaaacattgtgttgcacaccaaatatgtatacatttttaaaagactagttgagtacagtagtgaaaaaggaggaaagagtagaacaaggagtttgatctgtaactgactgtgaacaatccattgagagaactcactacctttgaaccagcctaaatatgcagtttttataataataaagaaaaagacaaagtgaccaaggtcaattcccagctaaactgtctatcacttctccaattcccactctccagcacctccaaaccgtggggcatctcacctcatactgtagggagagatgggtccagaagtctagttgtggactgaaaaccagtttgccctcccagagctaaagcagagggtttccgtgctggccacatagcttcctcttgcaactagaggtctcagcaccttgaagggacaattcataatcaggggaaaaaaagacaacacaggccttcccgctagtccagtctaaacagatccttcgtgtttgtctggaatgctttgcataggcagccatgctgagggcaagtgagattaggataatccagagtatttgcttgttaagacccttaaacaaaaccggagcgcggaagaaaagcccggtgtaagctgacgagtttgtgagtgcaatctgcggatttgtcggaggtgatttcgccagctaaagggataaactagacagctgtgccgaagagccttaacctgtgaaatatcgttcaaagtacaggctttggaggcagggaggggaggaagtagaggcctcagcaaaggttgtggcatggttcttttgaaatctattagaagaaggaaggaaacaggctcagagagattcccactgcatgtgcttaagaggctggagtgtctggcttcgctggagtcaattgcttaagaatctgctctgttgtgcttttttttctccacattctctcttcacctccttgttgaccttccaagatcccagctctcccacttctgcacaaaagcaaagacccatttatttattttgttaaagaaaaggaactggagaggtttgatgtcgcaggaaattggagcatctctccttccagtgacaggatcccagaggccatccctgagctaatgactctaagagaaagaatttcccctcagtgaagggccattagcaagagctggtgtccaggttctcagaagtcactgggatgcccgtaattgagcagcctcagggcctctgggaaggagccagggtcgaggagattcctttgcacctgcaaagcctggttagctgccccagaccccgggcccagcattaatagaatcctcctggcccacagcatccctcttgctctcattatccaaagcctgggacattcttatgccctggacttgctcccagatgaggaacacactgccagccagtgacaagcccacatctccaaggcgtcccctgagaatcccaggatgtgcttacatcacacagcctagagtttgcaccagaccagacagagacttaagtcactgctcaaaagctcctttcaggtcagggaggaaaagtcactggggaggtgaaatgactctggactttctgggagaaaaatgagcagctgctgaggcatgaggcaagaagatgatgcctacaggaaccctggcttgtggttggttgggtgaagccggttcctgtttcatctgtgtcgttaattgcttggtaatgaaacgtaaggccctaatttgactgggctcaattttccacctacaaagtgatggttcacgtgttcacagcctcgtgtcccgatgaagatgccacgggtgagtattctttgaaaaccaagaagagtgatgtaaatgtggtgcactttatcatgaggtagttgaactgaaggctctttaagctccttctcttgcactatgagtaaatgaattgcttgattgattgattaatccttaccattttgaatgtctgaaatgcttgattcacacttaggagtgaccgttatcgcacctttgagccatgttctcagactttaccgttaacgttttcagagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccatgtaagttctcctgggtccactgcccacggactctgggatcccactctgcagcgctctctcctcccagctccctgctacctctagccaggctcatctatctgtctgtccacttaaaaactcgtcaggctttctgtatgtgccaggcaggcatcgtctaggtgttgaggctgcacacacccggcccctccttcctggaactcacagcatagtgaattgccacagaaagcatgtccacagtgatttgaaaacccaagctggaaggccaggcatggtggctcacgcctgtaatcctaacactttgggaggctgaggtgggtggatcacctgaggtgaggaattcgaaaccagcctgaccaacatggtgaaaccccttctctactaaaaattcaaaagttagccagttatggtggtgagtatccgtaatcccagctacctgggagactgaggcaggacagttgctggaacccgggaggcggaggctgcagtgagctgagatcatgccactgcattccagcctaggcgacagagcaagattccgtgtcaaaaaaaaaa

SEQ ID NO: 19877 - DNA, 2090 bp, Homo sapiens
  ENST00000518140
agaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggtaatcaggttacggggctgggccccgctttctgactcagaatgcagcagccccagagaggccaataatccaatctggaggacagcgagcactgtaatggctcctggggagcatctttgcaaattaaattggggaaattcagttagccctgcagaaaaccagttaccttatggatttaaaataaaacacacacacacacacacacacacaataaaagcatggggaggaggagacggttgcaggggagacaggacccaggcagcagcgtgtctccaagagctaaggagaaggtggggctggggcggcctttgcacatgtgcctgttacaggctaagatttatatttttcgtttccaaagtgtgctccccaaagggcaagtagagaaatacatatagctcaggcgaggctacagacggtgtgtaatcttggggacctcccactcccttcggagacagaccatggtacagccctttgaccacagtatgttataggttccacatgttcacgaaaaacactttcactagcttagctcctccatccctgattactgtgttctgagtacggagagaacagtaaagagtcgtgcttgggaag

SEQ ID NO: 19878 - DNA, 987 bp, Homo sapiens
  ENST00000521150
gacagtcagagaggagagacggagcagcgtggcagacaggctggctctgcacgagctcctggcggggaccagcagcgcctgcaagggggtggagggacaggcgctcgggtggcctgggccgccggcccctcacgctgcccccgctcagccttcatgctctcccctgcttttccacaggcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacact

SEQ ID NO: 19879 - DNA, 972 bp, Homo sapiens
  ENST00000521130
gcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactgcccagtgtggaactctgttggatggcactagacagaaatcacatccctcctacaggatttctacaaagcacgtgttcctggagcaactattatgaggaagatagagaaggcctagaaaatttggtccctgttgcctttgagacttgcaccatcaccctgcaactgagcactctgaccaaatatcaagatcaactgtgctttctgaaagatcaaattaagtctaattttaaatgggacaaaaggtagcactctttttatattcctacttaagaagatatccttcttggttctgttccattttgcacatggagtagttttaaagagccacatccaaggctggatttgaaagctgatgaacgtagctatgaagagctttatgatgaaaagggttattactggcctcccatctactggcttatctttttttattctttaagtcatgtgacaaatgagggttctgataggattgtctttggtgtggtttcatgag

SEQ ID NO: 19880 - DNA, 8903 bp, Homo sapiens
  ENST00000404867
agagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagtactctggttttgctgcccagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgaggcaactggaagaaggaaggaaggaaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccgcagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagccctgc

SEQ ID NO: 19881 - DNA, 5189 bp, Homo sapiens
  ENST00000377084
cgcgctctcttcctccctcagacaactcgccccccgccctccgcccccctccacgtaattccgaaagagcagaagaaagagaaggagaacaggaaaagaagagctagtaagcgagagcgagagcacagaaaagaaaaaaaaaagccttaagaggaccgaaggggaggaaaggaaaaggatggacaaccacaaaacgcagcgattgcggaaattttccagcgccattggctgggcagcgtgagtccttcggtcgggcgtgatttcagcaccgggggaactggacagcacctcggggggacttctgggcaacccgcaaccacagcaagaactccaccagcagcctcaacaacagaagccgcggaaaaccctgctttgtatcagagaggcaaggtcagtccgacgcacagccatgcacaggcagtgcgcctgtactacgctgcaaaccctctgcttgtttctctaacatgcacttgcttctaattactagcattgtttcatttctgatcagtgaagatcagtagatgagattctgtaagggtgtacttttaatttatatgtatatatttaacttctttttctgttatttttaaagtgttgtgggggagtggggtttttttcctacttttttttttttttttttttctttgcttgccttgcactacgtgcctggatagtttgtggatataattattgactggcgtctgggctattgcagtgcgggggggttagggaggaaggaatccacccccacccccccaaacccttttcttctcctttcctggcttcggacattggagcactaaatgaacttgaattgtgtctgtggcgagcaggatggtcgctgttactttgtgatgagatcggggatgaattgctcgctttaaaaatgctgctttggattctgttgctggagacgtctctttgttttgccgctggaaacgttacaggggacgtttgcaaagagaagatctgttcctgcaatgagatagaaggggacctacacgtagactgtgaaaaaaagggcttcacaagtctgcagcgtttcactgccccgacttcccagttttaccatttatttctgcatggcaattccctcactcgacttttccctaatgagttcgctaacttttataatgcggttagtttgcacatggaaaacaatggcttgcatgaaatcgttccgggggcttttctggggctgcagctggtgaaaaggctgcacatcaacaacaacaagatcaagtcttttcgaaagcagacttttctggggctggacgatctggaatatctccaggctgattttaatttattacgagatatagacccgggggccttccaggacttgaacaagctggaggtgctcattttaaatgacaatctcatcagcaccctacctgccaacgtgttccagtatgtgcccatcacccacctcgacctccggggtaacaggctgaaaacgctgccctatgaggaggtcttggagcaaatccctggtattgcggagatcctgctagaggataacccttgggactgcacctgtgatctgctctccctgaaagaatggctggaaaacattcccaagaatgccctgatcggccgagtggtctgcgaagcccccaccagactgcagggtaaagacctcaatgaaaccaccgaacaggacttgtgtcctttgaaaaaccgagtggattctagtctcccggcgccccctgcccaagaagagacctttgctcctggacccctgccaactcctttcaagacaaatgggcaagaggatcatgccacaccagggtctgctccaaacggaggtacaaagatcccaggcaactggcagatcaaaatcagacccacagcagcgatagcgacgggtagctccaggaacaaacccttagctaacagtttaccctgccctgggggctgcagctgcgaccacatcccagggtcgggtttaaagatgaactgcaacaacaggaacgtgagcagcttggctgatttgaagcccaagctctctaacgtgcaggagcttttcctacgagataacaagatccacagcatccgaaaatcgcactttgtggattacaagaacctcattctgttggatctgggcaacaataacatcgctactgtagagaacaacactttcaagaaccttttggacctcaggtggctatacatggatagcaattacctggacacgctgtcccgggagaaattcgcggggctgcaaaacctagagtacctgaacgtggagtacaacgctatccagctcatcctcccgggcactttcaatgccatgcccaaactgaggatcctcattctcaacaacaacctgctgaggtccctgcctgtggacgtgttcgctggggtctcgctctctaaactcagcctgcacaacaattacttcatgtacctcccggtggcaggggtgctggaccagttaacctccatcatccagatagacctccacggaaacccctgggagtgctcctgcacaattgtgcctttcaagcagtgggcagaacgcttgggttccgaagtgctgatgagcgacctcaagtgtgagacgccggtgaacttctttagaaaggatttcatgctcctctccaatgacgagatctgccctcagctgtacgctaggatctcgcccacgttaacttcgcacagtaaaaacagcactgggttggcggagaccgggacgcactccaactcctacctagacaccagcagggtgtccatctcggtgttggtcccgggactgctgctggtgtttgtcacctccgccttcaccgtggtgggcatgctcgtgtttatcctgaggaaccgaaagcggtccaagagacgagatgccaactcctccgcgtccgagattaattccctacagacagtctgtgactcttcctactggcacaatgggccttacaacgcagatggggcccacagagtgtatgactgtggctctcactcgctctcagactaagaccccaaccccaataggggagggcagagggaaggcgatacatccttccccaccgcaggcaccccgggggctggaggggcgtgtacccaaatccccgcgccatcagcctggatgggcataagtagataaataactgtgagctcgcacaaccgaaagggcctgaccccttacttagctccctccttgaaacaaagagcagactgtggagagctgggagagcgcagccagctcgctctttgctgagagccccttttgacagaaagcccagcacgaccctgctggaagaactgacagtgccctcgccctcggccccggggcctgtggggttggatgccgcggttctatacatatatacatatatccacatctatatagagagatagatatctatttttcccctgtggattagccccgtgatggctccctgttggctacgcagggatgggcagttgcacgaaggcatgaatgtattgtaaataagtaactttgacttctgacaaaaaacaaaaagtgctgcatggctcgcatggaatccacgcgctccagggactctgcccgcccccgcgactggagacggcatctcgttcacagcacccaccctcttacctgataagttccatcgtatcaaactttctataaacaaaatacagtataatcagaaagtgccatttcgccattatttgtgatcggtaggcagttcagagcataagttaactgtgaaaaaaatgtaaaggttttatttaggacatttgcatggctagtcatcagtccattttatgagttaacaatgtattttgttgagggaagtttttaggggttgttttgggttcttttattttgatggtgatgttttattttattttatttttttcagggggtcttttttttaatacatatccaataatgccttccatctgaatgtaaaataagtacccatgatttctattatagtatcagtgtaattatttaaaaaatgattttgaggcagttaagcatgaccaattaatgtcactctagtgcttaggctgcgatcctatggtagcaattctgtgctggtataaatcttacttataaagtaggaaaagagaaccgaggaagcacgtgaaacttactaattctattcgaggattttataatggcatattttttcagtattaaagcgaaaatgttttcaactctgggtccttacctttttccagcttcatatttgcaagtggtaaattggatttgcggtggaagagacaggggagggaaacggttggggttagatcccttcctgagctacattaaggctctttctctaatcgccttacttagctttttaccctttaagtagctcctcttccctcgcccccaccctctaccccacccccaccttcgctcagactttaccggctttccccagtccataaaggtcttgccccaacactcaccccttctttttttcccctctccaaatgcagcagtgaatccctttattaatactggaaatccctctctgctgcttttgttggtgctgcccacactgcagatatattaaggatgttaggagagatttgatttaattgactctgcctagataggtctcattaaacagagtggagatttcattggtcagcactcctcaatgaaagacagacctaatgactggcatttgagatgctgctggcattttgaattcaacatctgctgaaaacggtaaaactaattagtgcccacccaccctccccgccccagcaactgcatattgaaatttgttaaagcactcatctttatggaaattaatcattatcctaaagaagtgtttctctcccatcatccggatttctggttgtggcccagcaattaacaaaaacagcttcaactgttcgaattttatgaaccaatgtaactctggcctcaatcatattcctctgggatttctaaacagcagttaagctacaaaaagcaaacaaaaccacacatattgatggagtctgcattccaccacatatccacccttgagaagtatgtcaaaagactgcagactatagatttttttttaatataggattataaatcagctagtgaaagacctcagagcagttgtaagtagatctgccatctagaactcatattctaaagggaagtgatttctcagaacagtgatgttctggaatatgtattatttattttaacacttttttaataaaatctttattataaaccatga

SEQ ID NO: 19882 - DNA, 4318 bp, Homo sapiens
  ENST00000400286
atatgacactggcagattaaaacgctctgatggggaagggcttaaaggctgagtcaaaagccaagaagtctctttatttacgcctacctcccagcccttggcaatctgactaataacaaactgagctaacaagaaatactagaaaaggaggaaggagaacattgctgtagcttggatctacaacctaagaaagcaagagtgatcaatctcagctctgttaaacatcttgtttacttactgcattcagcagcttgcaaatggttaactatatgcaaaaaagtcagcatagctgtgaagtatgccgtgaattttaattgagggaaaaagggacaattgcttcaggatgctctagtatgcactctgcttgaaatattttcaatgaaatgctcagtattctatctttgaccagaggttttaactttatgaagctatgggacttgacaaaaagtgatatttgagaagaaagtacgcagtggttggtgttttcttttttttaataaaggaattgaattactttgaacacctcttccagctgtgcattacagataacgtcaggaagagtctctgctttacagaatcggatttcatcacatgacaacatgaagctgtggattcatctcttttattcatctctccttgcctgtatatctttacactcccaaactccagtgctctcatccagaggctcttgtgattctctttgcaattgtgaggaaaaagatggcacaatgctaataaattgtgaagcaaaaggtatcaagatggtatctgaaataagtgtgccaccatcacgacctttccaactaagcttattaaataacggcttgacgatgcttcacacaaatgacttttctgggcttaccaatgctatttcaatacaccttggatttaacaatattgcagatattgagataggtgcatttaatggccttggcctcctgaaacaacttcatatcaatcacaattctttagaaattcttaaagaggatactttccatggactggaaaacctggaattcctgcaagcagataacaattttatcacagtgattgaaccaagtgcctttagcaagctcaacagactcaaagtgttaattttaaatgacaatgctattgagagtcttcctccaaacatcttccgatttgttcctttaacccatctagatcttcgtggaaatcaattacaaacattgccttatgttggttttctcgaacacattggccgaatattggatcttcagttggaggacaacaaatgggcctgcaattgtgacttattgcagttaaaaacttggttggagaacatgcctccacagtctataattggtgatgttgtctgcaacagccctccattttttaaaggaagtatactcagtagactaaagaaggaatctatttgccctactccaccagtgtatgaagaacatgaggatccttcaggatcattacatctggcagcaacatcttcaataaatgatagtcgcatgtcaactaagaccacgtccattctaaaactacccaccaaagcaccaggtttgataccttatattacaaagccatccactcaacttccaggaccttactgccctattccttgtaactgcaaagtcctatccccatcaggacttctaatacattgtcaggagcgcaacattgaaagcttatcagatctgagacctcctccgcaaaatcctagaaagctcattctagcgggaaatattattcacagtttaatgaagtctgatctagtggaatatttcactttggaaatgcttcacttgggaaacaatcgtattgaagttcttgaagaaggatcgtttatgaacctaacgagattacaaaaactctatctaaatggtaaccacctgaccaaattaagtaaaggcatgttccttggtctccataatcttgaatacttatatcttgaatacaatgccattaaggaaatactgccaggaacctttaatccaatgcctaaacttaaagtcctgtatttaaataacaacctcctccaagttttaccaccacatattttttcaggggttcctctaactaaggtaaatcttaaaacaaaccagtttacccatctacctgtaagtaatattttggatgatcttgatttgctaacccagattgaccttgaggataacccctgggactgctcctgtgacctggttggactgcagcaatggatacaaaagttaagcaagaacacagtgacagatgacatcctctgcacttcccccgggcatctcgacaaaaaggaattgaaagccctaaatagtgaaattctctgtccaggtttagtaaataacccatccatgccaacacagactagttaccttatggtcaccactcctgcaacaacaacaaatacggctgatactattttacgatctcttacggacgctgtgccactgtctgttctaatattgggacttctgattatgttcatcactattgttttctgtgctgcagggatagtggttcttgttcttcaccgcaggagaagatacaaaaagaaacaagtagatgagcaaatgagagacaacagtcctgtgcatcttcagtacagcatgtatggccataaaaccactcatcacactactgaaagaccctctgcctcactctatgaacagcacatggtgagccccatggttcatgtctatagaagtccatcctttggtccaaagcatctggaagaggaagaagagaggaatgagaaagaaggaagtgatgcaaaacatctccaaagaagtcttttggaacaggaaaatcattcaccactcacagggtcaaatatgaaatacaaaaccacgaaccaatcaacagaatttttatccttccaagatgccagctcattgtacagaaacattttagaaaaagaaagggaacttcagcaactgggaatcacagaatacctaaggaaaaacattgctcagctccagcctgatatggaggcacattatcctggagcccacgaagagctgaagttaatggaaacattaatgtactcacgtccaaggaaggtattagtggaacagacaaaaaatgagtattttgaacttaaagctaatttacatgctgaacctgactatttagaagtcctggagcagcaaacatagatggagagtttgagggctttcgcagaaatgctgtgattctgttttaagtccataccttgtaaataagtgccttacgtgagtgtgtcatcaatcagaacctaagcacagcagtaaactatggggaaaaaaaaagaagaagaaaaagaaactcagggatcactgggagaagccatggcattatcttcaggcaatttagtctgtcccaaataaaataaatccttgcatgtaaatcattcaaggattatagtaatatttcatatactgaaaagtgtctcataggagtcctcttgcacatctaaaaaggctgaacatttaagtatcccgaattttcttgaattgctttccctatagattaattacaattggatttcatcatttaaaaaccatacttgtatatgtagttataatatgtaaggaatacattgtttataaccagtatgtacttcaaaaatgtgtattgtcaaacatacctaactttcttgcaataaatgcaaaagaaactggaacttgacaattataaatagtaatagtgaagaaaaaatagaaaggttgcaattatataggccatgggtggctcaaaactttgaacatttgagcttaaacaaatgccactctcatgcattctaaattaaaaagttaaaatgattaatagttcaggtggaagaaataagcatactttttgggttttctacacattttgtgtagacaattttaatgtcagtgctgctgtgaactaaagtatgtcatttatgctcaaagtttaattcttcttcttgggatattttaaaaatgctactgagattctgctgtaaatatgactagagaatatattgggtttgctttatttcataggcttaattctttgtaaatctgaatgaccataatagaaatacatttcttgtggcaagtaattcacagttgtaaagtaaataggaaaaattattttatttttattgatgtacattgatagatgccataaatcagtagcaaaaggcacttctaaaggtaagtggtttaagttgcctcaagagagggacaatgtagctttattttacaagaaggcatagttagatttctatgaaatatttattctgtacagttttatatagttttggttcacaaaagtaattattcttgggtgcctttcaagaaaattaaaaatactactcactacaataaaactaaaatgaaaa

SEQ ID NO: 19883 - DNA, 568 bp, Homo sapiens
  ENST00000559460
aaataatccttgcagtgttacaacagtgtgcccgtgtagagaactgttttgcaaagagctcgatcaatgatgtcatctttgccttccgtgacccaggcagctgggtgcagtctcaagatcggagactgaggcttcaacaaagtattgggttcaaattccagctctgccacttggaaccctgagtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaacc

SEQ ID NO: 19884 - DNA, 6247 bp, Homo sapiens
  ENST00000327367
acttggagtctcgcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 19885 - DNA, 579 bp, Homo sapiens
  ENST00000559937
tttcctcctcttacccagtggctgttaacagcaggttttctgcccgagttatccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttgggtgagtatctccttgtgcacacaactggaaccccctctagctgcagccctggcgagtcgccagtgtgggga

SEQ ID NO: 19886 - DNA, 584 bp, Homo sapiens
  ENST00000559092
agcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtccctggatggccggttgcaggtgtcccatcggaaggggctccctcatgtcatctactgccgcctgtggcgatggccagacctgcacagccaccacgagctacgggccatggagctgtgtgagttcgccttcaatatgaa

SEQ ID NO: 19887 - DNA, 542 bp, Homo sapiens
  ENST00000560175
aaaacaagcttcgggagttgggagagaactgtccacaggacacttggggaggcttgctttggttgtggaggcctccacagcccccggaaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttgg

SEQ ID NO: 19888 - DNA, 1567 bp, Homo sapiens
  ENST00000540846
aaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttg

SEQ ID NO: 19889 - DNA, 797 bp, Homo sapiens
  ENST00000558894
caagccttggccagacgtggatatggttatgcacggactccgttttgtggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggatgcaacctgaagatcttcaacaaccaggagttcgctgccctcctggcccagtcggtcaaccagggctttgaggctgtctac

SEQ ID NO: 19890 - DNA, 1530 bp, Homo sapiens
  ENST00000439724
ccctgtgacctcccaacttcacaaacatgtcttgcctgcaccctaggcaaacgtggaaaggcgcagctctggtacaccggaaagcatggtggatggggaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaaca

SEQ ID NO: 19891 - DNA, 586 bp, Homo sapiens
  ENST00000558739
aggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgca

SEQ ID NO: 19892 - DNA, 1147 bp, Homo sapiens
  ENST00000537194
agtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcggagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttg

SEQ ID NO: 19893 - DNA, 554 bp, Homo sapiens
  ENST00000558428
acacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacagga

SEQ ID NO: 19894 - DNA, 552 bp, Homo sapiens
  ENST00000558827
acacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatgagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcct

SEQ ID NO: 19895 - DNA, 590 bp, Homo sapiens
  ENST00000560402
ttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacactttt

SEQ ID NO: 19896 - DNA, 775 bp, Homo sapiens
  ENST00000560424
gcctcagtgacagcgctatttttgtccagtctcccaactgtaaccagcgctatggctggcacccggccaccgtctgcaagatcccaccaggaaaggcccccctctccacaccatctccctatttttggaagccctctttgcagacttctccctgctctgggagtcggagcttgtgggccagccttccatctccccttgcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctcccccca

SEQ ID NO: 19897 - DNA, 1957 bp, Homo sapiens
  ENST00000558763
tgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctctttt

SEQ ID NO: 19898 - DNA, 3087 bp, Homo sapiens
  ENST00000262158
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttga

SEQ ID NO: 19899 - DNA, 2211 bp, Homo sapiens
  ENST00000545051
agtctcattgagcctgactcgagtaatgattaactggctgcccggagcccagacgggtgacaaggtgctgtggtctgtcttacgatgggcagtgaagcctgagcagaccattaataatcagcatcaaggccgcgagtcagccttttggaatgtgtggtttgtctttcatgctgtttagagcgtgcttaaagatggatcttggtgtttttatttgtgtatttatttctttctctccccttttcaaatccacagcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaac

SEQ ID NO: 19900 - DNA, 1152 bp, Homo sapiens
  ENST00000591805
agtaaatacggagaatcacgtcgaacaccagtggcccagatactgtcgtggccgcgcacctttggagttttggggcaaagagagttggatggaaggccgaactggagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgca

SEQ ID NO: 19901 - DNA, 1278 bp, Homo sapiens
  ENST00000589634
atgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtag

SEQ ID NO: 19902 - DNA, 549 bp, Homo sapiens
  ENST00000587336
aagtacagtgcggccctggcctggccaggccctggtattgggttgtaaaattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagc

SEQ ID NO: 19903 - DNA, 563 bp, Homo sapiens
  ENST00000585986
tgtcttacgatgggcagtgaagcctgagcagaccattaataatcagcatcaaggccgcgagtcagccttttggaatgtcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgag

SEQ ID NO: 19904 - DNA, 574 bp, Homo sapiens
  ENST00000586093
gttatcataagtttctatctctcttctcatggctgggcctttattttctcttgcttttttaatttcagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaag

SEQ ID NO: 19905 - DNA, 401 bp, Homo sapiens
  ENST00000588190
atatgccgcggcggctgagtgtgacctagcgcagaacagggcttccctcttgtgtcctccgtggggagtccaggagagggacttggtccttctggctgactccgtgcttggaaggtgtgctcccctctcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagtt

SEQ ID NO: 19906 - DNA, 1076 bp, Homo sapiens
  ENST00000598409
gtctgcgcagccgcagtcagtgcggcgccagctctgcagagcccagacagggtccggttggggaggtcctcaggttctgaatcttgtgcctggagaaccagagaggaccctggagcaggaggagaaagagaagcttgtctcagaagctccacctcctcctggggcaatgcagagtctcaggcctgagcagacacgggggctgctggagcctgagaggaccaagactctgctgcctcgggagagccgggcctgggagaagcctcctcatcccgcctgcaccaaagactgggaggctgtggaggttggggcctccagccatgacagtgatgagaaagacctgtcttctcaagagactgggctttcccaggagtggagctcggtggaggaagatgacgaatcagagggctcccagggctttgtggagtggtcaaaagctccacaacaaacaaccatagtcttggtagtgtgcgtgctttttttgttcctggttttaacggggatgcctatgatgtttcacatttaactataatggtggctgttgttttaaaagtttaatttaatgaaatagatgccctatgtcatgttaaggaattgtgctagttaaaaatcaggaataggtgttgaatattttcaaatgcctttcaaacatcctttgagatgatttttaaaaaatttttggtgtgagttttcacatactttatttccatgaaatgaagacatcattgattgtaaaacattattttgtataccacggagaaagaaaagtgctaattaatcattaagatgccaccaactggaagatatctcctgactttgagaagatgaaaaaatgtgcaactgaagatcaatgaaatctggtacatttcctaacatcaaaccaactttgcattcttaaggttttggtgcaccagtcttttcatacactagattatatttattgatattttatgtaggattcttgcctctatcttcacatgtgagattggtgctatctttgtgaagttttggtatcatggttaagcttgcatcatagaaagacttgggtaacttttaccttttctatgcttttcaatagt

SEQ ID NO: 19907 - DNA, 573 bp, Homo sapiens
  ENST00000600547
agtgcggcgccagctctgcagagcccagacagggtccggttggggaggtcctcaggttctgaatcttgtgcctggagaaccagagaggaccctggagcaggaggagaaagagaagcttgtctcagaagctccacctcctcctggggcaatgcagagtctcaggcctgagcagacacgggggctgctggagcctgagaggaccaagactctgctgcctcgggagagccgggcctgggagaagcctcctcatcccgcctgcaccaaagactgggaggctgtggaggttggggcctccagccatgacagtgatgagaaagggctttgtggagtggtcaaaagctccacaacaaacaaccatagtcttggtagtgtgcgtgctttttttgttcctggttttaacggggatgcctatgatgtttcacatttaactataatggtggctgttgttttaaaagtttaatttaatgaaatagatgccctatgtcatgttaaggaattgtgctagttaaaaatcaggaataggtgttgaatattttcaaatgcctttcaaacatcctttgagatgatttttaa

SEQ ID NO: 19908 - DNA, 570 bp, Homo sapiens
  ENST00000555917
agctaatgtctgatcggggggatggctgaggacctcaggttctggtgtccaggtgctctgagctcttaaaaaaggaaggaattacttcaatatgaaatcagatggttcccttccacgtggtgtggtggaaagagcatagactttgaggcccacagactgtaactttaacataccgacttttcagagcgtcataaggataaatgcacttatatggagtctcactctgtcaccaggctggagtgcagtggcacgatctcggctcactgcaacttctgcctccccggttcaagtgattctcctgcctcagcctcctaagtagctgggactacaggtgtgcagcaccacactcaggaaaccactggactttgggaaaaccatgtggcagagtcgggaccacaaacatgtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaag

SEQ ID NO: 19909 - DNA, 2040 bp, Homo sapiens
  ENST00000361956
aggcgtccaacctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagtaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatcca

SEQ ID NO: 19910 - DNA, 3666 bp, Homo sapiens
  ENST00000381280
cctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 19911 - DNA, 551 bp, Homo sapiens
  ENST00000553839
gtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaaggtgagtggagttttatgctttatctaaatgtttgcttccaaaggtggtccaagcaggatttcttagatgagatagaaggagcctggggtgaaagcctaaggtgtcccgcagaacatcttctcc

SEQ ID NO: 19912 - DNA, 519 bp, Homo sapiens
  ENST00000557483
tgtgaggaagggaggggaactgggaggagtggatgtgggagagagctgaagcctcaatgcctcagactttgaaaaatgactattaagaagtctgaggttacacttccactcacatagtctctttgcccagactttttctctctccttttcctcacccctagaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccagg

SEQ ID NO: 19913 - DNA, 938 bp, Homo sapiens
  ENST00000379494
aacacttagccttaacggtttaagttcccctccagccccgagccaggagcagttctcaataccgggagaggcacagagctatttcagccacatgaaaagcatcggaattgagatcgcagctcagaggacaccgggcgccccttccaccttccaaggagctttgtattcttgcatctggctgcctgggacttcccttaggcagtaaacaaatacataaagcagggataagactgcatgaatatgtcgaaacagccagtttccaatgttagagccatccaggcaaatatcaatattccaatgggagcctttcggccaggagcaggtcaaccccccagaagaaaagaatgtactcctgaagtggaggagggtgttcctcccacctcggatgaggagaagaagccaattccaggagcgaagaaacttccaggacctgcagtcaatctatcggaaatccagaatattaaaagtgaactaaaatatgtccccaaagctgaacagtagtaggaagaaaaaaggattgatgtgaagaaataaagaggcagaagatggattcaatagctcactaaaattttatatatttgtatgatgattgtgaacctcctgaatgcctgagactctagcagaaatggcctgtttgtacatttatatctcttccttctagttggctgtatttcttactttatcttcatttttggcacctcacagaacaaattagcccataaattcaacacctggagggtgtggttttgaggagggatatgattttatggagaatgatatggcaatgtgcctaacgattttgatgaaaagtttcccaagctacttcctacagtattttggtcaatatttggaatgcgttttagttcttcaccttttaaattatgtcactaaactttgtatgagttcaaataaatatttgactaaatgtaaaatgtgaa

SEQ ID NO: 19914 - DNA, 533 bp, Homo sapiens
  ENST00000494525
ttccaccttccaaggagctttgtattcttgcatctggctgcctgggacttcccttaggcagtaaacaaatacataaagcagggataagactgcatgaatatgtcgaaacagccagtttccaatgttagagccatccaggcaaatatcaatattccaatgggagcctttcggccaggagcaggtcaaccccccagaagaaaagaatgtactcctgaagtggaggagggtgttcctcccacctcggatgaggagaagaagccaattccaggagcgaagaaacttccaggacctgcagtcaatctatcggaaatccagaatattaaaagtgaactaaaatatgtccccaaagctgaacagtagtaggaagaaaaaagtggtaaaagaactcagtgatatcaaagaattgaagaggaacaaaataagtatcaaagtggtaatgacgcatcaattacaagaaaaagaaatgattagcaaaggattgatgtgaagaaataaagaggcagaagatggattcaatagctcactaaaatttt

SEQ ID NO: 19915 - DNA, 2010 bp, Homo sapiens
  ENST00000020945
agttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaa

SEQ ID NO: 19916 - DNA, 626 bp, Homo sapiens
  ENST00000396822
tctggaagccaggcgggcagggcagagaccccggctcctgcgcccctcctagctcccagagagcgtggatcgcgggcggggctcaccgagcgagctgtcccagagggaggagctgaaatctgaacctctcagctgtgattggatctttcttgcaaaagagaggaaaaaaaaaccctcccagccaaaacgggctcagttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctc

SEQ ID NO: 19917 - DNA, 998 bp, Homo sapiens
  ENST00000563261
agggtgcgctcgccaggcctggggcgtggtgttgtctgcgcaggcgccgtgtgcccaggcgcctggcgtccgcgtcggcgatccggggtctgggcgcggcgaggtctggtgtggcagatgtggatagctggaccctcctgggtgcctctgcgttatgtcgtttggttgatgcatttggagagaatctgtgctctccacaactgcaggggcaacatgctttcctggcctcttcagatcagggtggctgttcttgggtgctgcaccaaaactccagcagtgggctttcttcaagtggccggctcacctcattcctgccaagacccaggtccgtgttctcacagtgctgccatctttcctccgtgtgagcgtgggctgtgcggagagtggacctcggtgtgtgcggggctgcgtgcactgccatcgctccctctacacgagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattgttttctgaatgtggaagcgtcggccgagcgcggtccttggagaacccttgctgcggagaatgacgctcactctgcggcctggcctcgcctccccatcccttctgcaaactcacaggacaggattgatggggagagcccaggcgaaacgaagctgaccctagtgaccagccctactggcggctctggaacaggcccgggaccggtggcctggagacagtggtcctttctggatgggctgcagtctccgaaggcttcccccactggagtcagccctttaggagtttgtccagtgcctccagaaagctgttttttgggggacggaggacttggcctggaattctggaattcccagggggtcagacatggttatgggaagtttaataaaaccggtgaatcacgtgaa

SEQ ID NO: 19918 - DNA, 829 bp, Homo sapiens
  ENST00000565633
gcgcaggcgccgtgtgcccaggcgcctggcgtccgcgtcggcgatccggggtctgggcgcggcgaggtctggtgtggcagatgtggatagctggaccctcctgggtgcctctgcgttatgtcgtttggttgatgcatttggagagaatctgtgctctccacaactgcaggggcaacatgctttcctggcctcttcagatcagggtggctgttcttgggtgctgcaccaaaactccagcagtgggctttcttcaaggtgagctgcaagatggaatctgaggcccacccgtcagtaagagtttcctcctggtatccatggaatctactggtctgtctcactttggcctttgacccaggcaggggttcctaacatctacatcggtcattcggacagccttgcttttggttcactgccttacacggggcttccagatgttgacctgcttcattttacagtatcaggaaatcactttcccctcagaaatggccggctcacctcattcctgccaagacccaggtccgtgttctcacagtgctgccatctttcctccgtgtgagcgtgggctgtgcggagagtggacctcggtgtgtgcggggctgcgtgcactgccatcgctccctctacacgagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattatgaagaaaccaaggctttgtgactaactcaacccctcaagaag

SEQ ID NO: 19919 - DNA, 588 bp, Homo sapiens
  ENST00000569786
gcgtcggcgatccggggtctgggcgcggcgaggtctggtgtggcagatgtggatagctggaccctcctgggtgcctctgcgttatgtcgtttggttgatgcatttggagagaatctgtgctctccacaactgcaggggcaacatgctttcctggcctcttcagatcagggtggctgttcttgggtgctgcaccaaaactccagcagtgggctttcttcaagtggccggctcacctcattcctgccaagacccaggtccgtgttctcacagtgctgccatctttcctccgtgtgagcgtgggctgtgcggagagtggacctcggtgtgtgcggggctgcgtgcactgccatcgctccctctacacgagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattgttttctggtatgtgggggatgtgccagaaccagggctgagctgtgaccacgagggccatcccgg

SEQ ID NO: 19920 - DNA, 2081 bp, Homo sapiens
  ENST00000563475
ccggggtctgggcgcggcgaggtctggtgtggcagatgtggatagctggaccctcctgggtgcctctgcgttatgtcgtttggttgatgcatttggagagaatctgtgctctccacaactgcaggggcaacatgctttcctggcctcttcagatcagggtggctgttcttgggtgctgcaccaaaactccagcagtgggctttcttcaagtggccggctcacctcattcctgccaagacccaggtccgtgttctcacagtgctgccatctttcctccgtgtgagcgtgggctgtgcggagagtggacctcggtgtgtgcggggctgcgtgcactgccatcgctccctctacacgagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattgttttctgatgaagaaaccaaggctttgtgactaactcaacccctcaagaaggacaaaactagcatcagagccccttgctcctgggtctggcaagaatgcctcttgtttgctgagaggtccacagatttacccggctcaagactgggagatgggaggtgaccaggtcagtgccagcctctctctgagctcctctgagtcgtggcagctgaggtgctcctccgagaatgttctgccatccgtgaggtcgtgtacgcctggaagcttttgttccattgaactctgccagggagctatacttagccacgcgagtggaggccaggagtgggttctctgaatatagatagtagcaagcaggctattttcaaacacctagagaacccccatgattattctgggccaaaatgatatttataggatgctctgggcccttggacatgaaggcaataaccttagcgccttttggcgttcgggataagtttctatcaacggggagtggagagagggacccggtcacccagaggcccgctgtccctcaacacctgtttccaggaggccaggcgtcttctttgcttttacactatgagtcagagaacagcgagaggcacgcagggccctactaattttccttcctgcacaccctggtgtgggtcctgtctgaggcctgccgtgtgctattagggaagacgtcatcaggggactttttctgctgtgaggagggtgcagcccctgcctttcagagctcaggacaccctcttcctcttgtccaggatcctcagggatttcctaggcttccaccctcacccagacatcactggaccgtcactgaaacacccgcttccagtgtgctcaggtcctgcagcctcctgtccatccttgccccgcctcccgcccggaggaaagactctgacactgcccctggaagagggaggagagtggatgtgatgagtgaagatttgggtggggaaaggaaggcctgagtcctgggaggaagagctctccccgccccgagcccccggagactgtgagcaaggctgagacgcctccttcctggtgctcaagctgcaggtgttggataggcctccagaagcccagattttaaatgaccgctccaggttaacctggggatggtcaggcagaacaaggaggagaggccagcagtgaagggcagggctggtgggcagtggctgggggtgtcctgggtggggctggccaccctcgctgcctctgacttgggccagacctgcgttaagtggagtggctcctccattctttacaccccaggcccctggcaggtgccctgcctttcctctgcccctctctctgccaacccatcctctccctcccagcccctgcccgcccagatataaatataagagcattttccatgggctgagacagaagggaaaacattcagctttattttcggcttgtgaaattcctgtccttcattcccaacaggtgcaatcgcctcatttagatattgggacccagaaatagaagacaatttacaatatagcttcctttagggatctggatgctaccaaacaaacaaacaaacaaaaaaagcc

SEQ ID NO: 19921 - DNA, 2096 bp, Homo sapiens
  ENST00000568633
ttgtatttgtagtagaaacagggtttcaccatgttggccaggctggtctcgaactcctggcctcagatgatctatccacctcaacctcccaaaatgctgggattacaggcgtgagccactgcgcccggccagcctttggtttttctatggcttacttggagttctctttaattctgacatagaagttcgcacaatccctcttttacagatgaagaaaccaaggctttgtgactaactcaacccctcaagaaggacaaaactagcatcagagccccttgctcctgggtctggcaagaatgcctcttgtttgctgagaggtccacagatttacccggctcaagactgggagatgggaggtgaccaggtcagtgccagcctctctctgagctcctctgagtcgtggcagctgaggtgctcctccgagaatgttctgccatccgtgaggtcgtgtacgcctggaagcttttgttccattgaactctgccagggagctatacttagccacgcgagtggaggccaggagtgggttctctgaatatagatagtagcaagcaggctattttcaaacacctagagaacccccatgattattctgggccaaaatgatatttataggatgctctgggcccttggacatgaaggcaataaccttagcgccttttggcgttcgggataagtttctatcaacggggagtggagagagggacccggtcacccagaggcccgctgtccctcaacacctgtttccaggaggccaggcgtcttctttgcttttacactatgagtcagagaacagcgagaggcacgcagggccctactaattttccttcctgcacaccctggtgtgggtcctgtctgaggcctgccgtgtgctattagggaagacgtcatcaggggactttttctgctgtgaggagggtgcagcccctgcctttcagagctcaggacaccctcttcctcttgtccaggatcctcagggatttcctaggcttccaccctcacccagacatcactggaccgtcactgaaacacccgcttccagtgtgctcaggtcctgcagcctcctgtccatccttgccccgcctcccgcccggaggaaagactctgacactgcccctggaagagggaggagagtggatgtgatgagtgaagatttgggtggggaaaggaaggcctgagtcctgggaggaagagctctccccgccccgagcccccggagactgtgagcaaggctgagacgcctccttcctggtgctcaagctgcaggtgttggataggcctccagaagcccagattttaaatgaccgctccaggttaacctggggatggtcaggcagaacaaggaggagaggccagcagtgaagggcagggctggtgggcagtggctgggggtgtcctgggtggggctggccaccctcgctgcctctgacttgggccagacctgcgttaagtggagtggctcctccattctttacaccccaggcccctggcaggtgccctgcctttcctctgcccctctctctgccaacccatcctctccctcccagcccctgcccgcccagatataaatataagagcattttccatgggctgagacagaagggaaaacattcagctttattttcggcttgtgaaattcctgtccttcattcccaacaggtgcaatcgcctcatttagatattgggacccagaaatagaagacaatttacaatatagcttcctttagggatctggatgctaccaaacaaacaaacaaacaaaaaaagccctcctgtgagatgccgagacttaatagaaaccgtggttggagctcttgcctttttccaggccggtggagaccctcacccctggcagcctgaccgtgaagcagaggaggcaagagctccgggagacagtcgggagggagggggccctggaggacaggctcctagccctactcctcctcaagacccgggtgctggcctgtcccctgcctttgccccgatggggatgagggagaggagatgggtcagggaacagctatggccattggggaaggtgacttggatgcaacctttgaaagagatgcttccagtaaaccccatcggttaagatc

SEQ ID NO: 19922 - DNA, 2048 bp, Homo sapiens
  ENST00000567997
tccgcacacatgtgtagtcacatgcgcatccacatacacataacagaagccagtgtccttcaccatgagccaggcactccggcagtttctgctctattttattttacaaaattgctgggggtgactgatgaaactgatttcaaaatgcacatttgaaaagcatggtcctagctggcaccccctggtggcagcccgggcctcgggtgtgggtccaggtgggatcccccccatccccaactctgggttctgagctgggataaaggcctcttggcggtgttgctgggggccacagccccaacagcgcccttcctgctctcccccaccggccacagagcgtgagtcccgaccaccgcgtccgccggcgcccctcagtgggcctttgtcccaagaagctgccaagccaggtggggactgctctcaccgcccgtgtggcaggctgtcctctgaaggacagagtcctcttctctcgtgtccctaagcctagcaggcagtgggaatgaacgggcagcccggttgctgggcacccatctccccagcctagccggtgtgtggaggattgcagccctttagcccagcctgcccaggcaagcctgccggggtgagcaggagggcttctggggtgaagggaggtgggggagggagggagaccacgggcggaggctcacctgaactgaatgcaggaggggcagtgcctttgcaccagaaagagcccatgtgtccttctcaccatcccctgtgcttacacccccagtcagcatgctccgggggtccctgagccgggccgccccagacggccctccttccctcccacccaccaccccgcgacccctcccaaacgtgtgcgccaggaagatgactccagggtgcctttagctggggctgtagtggttgggacgggcggctgtatatcaggggtgagttccagggagacttgggggcttagaaaacttagaaaacttctccaagttgggagagaatcccgcccgccctgccggaggcggggctcagtgccctgaagtggaggcgcccgtgggccacctccctccctgcagccgcagccgctgcgcagaggcgctggctccttctcctcccacctgggacaggtgtctccccagcccccgctcccaggggcctctctctctctcccgcccctcagggtcgagtcccggcaggggctcggggatcgggtagtcagtacctctctgcgtctccagccgccggtagttggggaccctgtggctggagtgcgttttcaccaggaaggagcgcggcatgttcccctcccgggcggcaggccggggtgggctggggcgggaggggcgcgcctgggtccggactgctgcgtccgccggcgcttgaaggggtcaggctcattagcatagcgcgccgcctccgccaaccagcgcccggcgcgagtggggcggggccacgggggcggaactgagggcgaggcggggtctcgggcaacacgcccaggacaggtgcgcgggcgggacggggcggggagcgcgtggccgccggtgtcctccccacgggaattctctggcgtgcgcgccgccgagtcacacaccgacccgtcgggcctggccacccactcgccgtgagtgaagggcagagttcaaagctgtgtggaaaccgagcgagaatctcttccacagaatgtggaagcgtcggccgagcgcggtccttggagaacccttgctgcggagaatgacgctcactctgcggcctggcctcgcctccccatcccttctgcaaactcacaggacaggattgatggggagagcccaggcgaaacgaagctgaccctagtgaccagccctactggcggctctggaacaggcccgggaccggtggcctggagacagtggtcctttctggatgggctgcagtctccgaaggcttcccccactggagtcagccctttaggagtttgtccagtgcctccagaaagctgttttttgggggacggaggacttggcctggaattctggaattcccagggggtcagacatggttatgggaagtttaataaaaccggtgaatca

SEQ ID NO: 19923 - DNA, 2656 bp, Homo sapiens
  ENST00000216294
acgccgtagggggcgggccgttcgggcttggtttcctgggcgaccaccgctggctagtccgttagaggcgtgcgggcttcggaggcgtgcgggcttcgggtgccatggggactcctcccggcctgcagaccgactgcgaggcgctgctcagccgcttccaggagacggacagtgtacgcttcgaggacttcacggagctctggagaaacatgaagttcgggactatcttctgtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaagatcagagttgccctgaaggattgggatgaagttttaaaatttcagcaagatttagtaaatgcacagcattttgatgcagcttatatttttaggaagctacgactagacagagcatttcactttacagcaatgcccaaattgctgtcatataggatgaagaaaaaaattcaccgagctgaagttacagaagaatttaaggacccaagtgatcgtgtgatgaaacttatcacttctgatgtattagaggaaatgctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgttttccagcatggtattattaagggatttaaagtttgggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctcaaaaaaaaaaaaaagtttgggttgaagatcaaattcgtgatatctctatatctaatctttaaaaatcagaatgctaatgctgacgcaaataaaattttcatttattagca

SEQ ID NO: 19924 - DNA, 723 bp, Homo sapiens
  ENST00000514467
gagcacagaacattccaggcaggcaaagccacccttgccctcctctccttggccacgtcctcaggggtgggcgagcttcggggggaggggtgggggtgaagactccgtgccaacgcaaaatactctgccaaaaggcttctcagacatgagtttcccagggcaatgcccaccttccgttccccgccttcccgagtctcttctcccagtttatgctggaaccctggaatggtctggggaccaatgagatggcagcggttaacgcttggatcacggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgag

SEQ ID NO: 19925 - DNA, 2359 bp, Homo sapiens
  ENST00000510658
aaagtgggaagcgcggacaaaaagtaggcggggaggagaggagagccccagctggggaaaagcaacggcagtcgaggtaaaaagagcgaaaggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccagtcagagattcaaggattttcaattcacatctgaatgagaattttctcttgctacggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcag

SEQ ID NO: 19926 - DNA, 586 bp, Homo sapiens
  ENST00000506272
agctggggaaaagcaacggcagtcgaggtaaaaagagcgaaaggtaaagaaagagcaggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctggg

SEQ ID NO: 19927 - DNA, 420 bp, Homo sapiens
  ENST00000508681
agtcgaggtaaaaagagcgaaaggtaaagaaagagcaggttcgtggacaggagccggcgggcaggccgggggatccctggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaaga

SEQ ID NO: 19928 - DNA, 2807 bp, Homo sapiens
  ENST00000509154
aaaaagagcgaaaggtaaagaaagagcaggttcgtggacaggagccggcgggcaggccgggggatccctgagacagggtttcaccatgttgcccaggctggtctcgaactcctggactcaagcagtctgtccatctcagcctcccaaagtgctgggattacaggtgtgagccaccacactggccaaggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggca

SEQ ID NO: 19929 - DNA, 3745 bp, Homo sapiens
  ENST00000261368
gcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgttctgatttctaagggactttgcaagtattttgattgctgatatttgatttcaggaacaaactgctcagtttagcagttttcccataggcgtcaaataaaacattctatatttcattaagta

SEQ ID NO: 19930 - DNA, 2564 bp, Homo sapiens
  ENST00000512385
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacct

SEQ ID NO: 19931 - DNA, 468 bp, Homo sapiens
  ENST00000514497
gcctacttcggctgaggctgttctgctcctgccgctgcggtccgtcggtcggtcagtcagtcccttcgcgctcctgagccgccggcgcgccgggcgccccggagacagggtttcaccatgttgcccaggctggtctcgaactcctggactcaagcagtctgtccatctcagcctcccaaagtgctgggattacaggtgtgagccaccacactggccaaggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattc

SEQ ID NO: 19932 - DNA, 4986 bp, Homo sapiens
  ENST00000261367
gctcctgccgctgcggtccgtcggtcggtcagtcagtcccttcgcgctcctgagccgccggcgcgccgggcgccccggaaaagagtgcctgagagtgccagaggcttggtggaagggcagacgagagaagaggaggcattgtattggccactgggacaactgcagactcactcttacctgtaaagaagcagttaatgttggggaatgtagtcaggattggaaaaccacggggatttctgcacattataattgagaatgtaaatattcttaaagtggcaccctgaaagagacaagcattgaaaccagacaaaataaattggatcatgaacagaatgagacatcttaaaggagatagcatgtggaggcctgctgggaagtagaggcaaattccagatgcctaggagccttagtctaaggtggggccatccaacccacagaaataaatatgggcagtggcccaagacttcctataatgagctgcacctgttgtaagtcttgtgttcttgcctatagaataaagaacctcactaccatcctgcaagtgcaaattgaaagattcctgttgtgatgccatgagttattatccgctggttatattctattggaatggctacactcaactggatattgctgtctatattgttggagcacctcaaacaggggtgcaatggttatttgttaatttacttaattaagacatgttcatccacattttatagtttcatttatttaaagatccatttggtccccagcttcgatgcatgtttctctgcttcatctccccatatttccatgttcctgctgatgtttataccatatcctggcacccagcatcatctgtgtgttgttcaccaaggccgtgggaacagagtctgtaaatcaatagttcatcacggagtacagatttcatgaaaagaaattggattggaagaaagtctcctagtgaacacgctagtatccaaagagtctggattgtatcagaatccatcacagtaggagagaatgttgttttgagtaatttccaagcagagtacatatattttcctctgaaaatctttgtaaattgaagaaaagtgacatttttataccaagcaatttgtttgataacctattttcagatttctacaaataataaaatttctgattttaaatattttttacaaatacaagttggttttcttttcattgtaagccttactgtgatttcagaagaatttttaacatttgctaaatggataatctcatttaaacatggaagtaacatcctaatcctttcttggatggactctgtatctattgtaattaagactttaaaaatggtatatacatatgggaaaaaaaggagaggaaacaggaaaattaaatcaagtgatgggtttgaggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttct

SEQ ID NO: 19933 - DNA, 2039 bp, Homo sapiens
  ENST00000510003
agtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacaggtacacaggccctgctgttttgcaatgagaaatgagtatatcaaatattaaacaaaacattaaaattatgttcactaggagaatgtctgaattaattcaccttttgtatggtcgtagacaataaggaattattgctctatttgtgtttccagaaatccacacaaatgtaggtaggcataaatatccataagagtttctctttcagtgtcccagggtgttgaaagggacttttcctgctcccttatcactgctctaaagccccagtgctgaggacaatagacattaaatttccccatgttctcaaggcaccagagaaaccactaccaggcagacatctgtctctcaagtggcaggctgctcttcccctaactagtaaatttcatcctccaggtatatgaagaataagatagatttttcaggaatggattagaattctttgtgtagggagttgtaggctagagagagaatgctgtagttccccctttctctgtagtaggactgagcttctcaaatgcattcaaaa

SEQ ID NO: 19934 - DNA, 1972 bp, Homo sapiens
  ENST00000509023
agtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatg

SEQ ID NO: 19935 - DNA, 2410 bp, Homo sapiens
  ENST00000508017
cgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgttctgatttctaagggact

SEQ ID NO: 19936 - DNA, 559 bp, Homo sapiens
  ENST00000509652
attgttcttttcatttgcccgcctcatgtggttcttattcttgctgtcacccgggatcttatcgcaggcagggatgggcagttccgcggctcggaaaagctgagataaggaggggcgaagtaatagtaatagcgacagtactaacaacggtaataatagctgtagaaaagggacgtctggtgttgctgccgcccctcgctcatcagcaccagctccccgactgccctgtccagcccgggctccgccagcctccctctagtgctgttctgcgtcccaggctggtccgcgtggatttcagaggggaatgtttctctcttggccttgtctcttggcgatgactttcatctgcaggtgagacagggtttcaccatgttgcccaggctggtctcgaactcctggactcaagcagtctgtccatctcagcctcccaaagtgctgggattacaggtgtgagccaccacactggccaaggaatttataagtatttgaccgtactcaaaatgtgcaaggaagaataatggaagcccctgaataccttgatttggatgaaattgacttt

SEQ ID NO: 19937 - DNA, 1849 bp, Homo sapiens
  ENST00000512146
atggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataa

SEQ ID NO: 19938 - DNA, 3126 bp, Homo sapiens
  ENST00000395469
atggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagactagactcaagattcaagggacttggaatgggagtgagacatgcctttttacacaccactttagctcctatccccctatctcttctgggctgcagtgtcaaggacaagaaggagttctttttattcctgatcaggttggcgcagcaacaaataaacaggtgttatttcaaaaccaattaccagagaccaaatccagttactagagcccaagcaaatgagaacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataa

SEQ ID NO: 19939 - DNA, 1888 bp, Homo sapiens
  ENST00000395466
atggaagcccctgaataccttgatttggatgaaattgactttagtgatgacatatcttattcagtcacatcactcaagacgatcccagaactgtgccgaagatgtgatacgcaaaacgaagacagatcagccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataa

SEQ ID NO: 19940 - DNA, 1708 bp, Homo sapiens
  ENST00000515215
atggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataa

SEQ ID NO: 19941 - DNA, 2303 bp, Homo sapiens
  ENST00000513719
gaccaaatccagttactagagcccaagcaaatgagaacaggtaagattccagtctccccctcttacaggcatctctgactatgagtgattctcttggagcccaaccatgacaagagacagaactccccaccacaaagactgcactgcatatctcataaaggagagcacactatggacagcctcctcctctccttcccagccccctccttatgtgggctgcagatgagcattgatagtagtaggactggctctgctacatcatcatagactctgaagggaggtgtgtgatattgactgctgaaaggtccctagaggctctcttcatactattcaacattctgttacagtcattaaaaaataatgtgtacagagatgtcctgatacacatgtccttcattttctgacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagcc

SEQ ID NO: 19942 - DNA, 2588 bp, Homo sapiens
  ENST00000379538
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgtt

SEQ ID NO: 19943 - DNA, 1591 bp, Homo sapiens
  ENST00000414317
atggaagcccctgaataccttgatttggatgaaattgactttagtgatgacatatcttattcagtcacatcactcaagacgatcccagaactgtgccgaagatgtgatacgcaaaacgaagacagatcaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagta

SEQ ID NO: 19944 - DNA, 1885 bp, Homo sapiens
  ENST00000504884
atggaagcccctgaataccttgatttggatgaaattgactttagtgatgacatatcttattcagtcacatcactcaagacgatcccagaactgtgccgaagatgtgatacgcaaaacgaagacagatcagccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagta

SEQ ID NO: 19945 - DNA, 2729 bp, Homo sapiens
  ENST00000542191
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgtt

SEQ ID NO: 19946 - DNA, 4538 bp, Homo sapiens
  ENST00000401884
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacaacccacagcctcggcgcagctcgagaacatggaggaagcccccaagcgggtcagcctggccctccagctccctgaacacggcagcaaggacatcggaagtgagtcagcagcgctggtggggactttgggactgactgactgctctcaggggccttagaggctgcaggcaggagggaccacccacggtgaggaatcaggaggcacagagcctacctgaggggaggctgagcaccaggcaccccggtgtgggaagatggggtgaagctacaccacccaagcagtgggaccccacagacgggaacaggccagggggcaggacccacccaaaccacccagagtctgagctagagagactggctttgatgctgcctcccctcccctctcctccttcgcctccacatgcagcagagcccaccccagcccctgcctctgggcccctcacccctcacttctccaaagaggagcaggcggagtcaggatgggagaagcagagggagcagccactgggcgagccccagcttgaggactagctgggccctgtggacactcaggttatgcaggacctgaactgtctcctagtccggggctctgcctcgtgaggatcgaggccagcacgtccctgcagggcaccaagcatctgctgagcacctgcagtaagagttcccagacgctcacgaggcagttccccttcgggcagcaccaatacatgtgtgttcctca

SEQ ID NO: 19947 - DNA, 7986 bp, Homo sapiens
  ENST00000405547
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgaaacaaagtaagagtcagacactggagaaatcttaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccacctgtgagtcctgcgatgcgtttaagcagcctgtgccctcacccaagctgcagttcctgaaggtgtagtctgtgtctctgcggatgagatgacagctcgccattccccggaatcagtgaggctgtcagtcagccacgcttctgcagtatgcagaaacctgttcttagactccaaagccagagaaagaattctcccttcgaggcccaacaaattgagaaggaactgtgatggaccacttccaaaacagagacgggggcaggggctgaagggcagagaccaggtgatgtcagaaggaaagccgggttgcagacacagccgcccctgctctggtcctccagcgtgtttatgacgctcgtgcaggtcgacgagccatcctatggactagttaacactaaggtggagttcagacttttttagacaacggcgcgactggcagcctttctctatcaagggtcagacggtaaacgttttcagctttgcagaccagaggtccctgtggctacagtagcgcagacacagccacaggcatgtcattgaatggctgcggctatgttccaataaaaacttatttacaataacaggtggtggccaaattggcccatgggccttatttggtgaaccctgttctatgagatcacctaggcttcagccttaaacagtggaagccatcccctgaatgacaagtcacaagggtatcaaagaaagacccctgaattttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccaccccacctcctctcgtgttgagcctcacgaccgctgacccagctggaaagccagcgccctgccgcgtcaccctgactctgctcagagccagcattccagccacaaagagggcctccttcctttcctctttcataaaaatgttttttgaagagttagagtatattttaggctttttatctttattaaaatttcatgtgcatgtgtctgtgtattctgcaatttgtcattttcagaaagaaggaacaggcaattcgcgaagtttcacctgtactcccgagctgttccccaggctccagacccacttgagagcagaaggtggagctcaatgaagggtctcgagctcagcgaagggtcactgggtgaactgagagaaaccacgttcacaaacgcgtactgcggacttcctgccgccctgggacctgtcactgtttgtccatgtaagctacagcattactagcagatgctaagatcgagtgatatcactggaaaagtaggtgaatcctactaggaaactttctactccctactaggacctcaagcccctcagccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagtgctgtcacaggacttgcccattgggatgttttccacattaaatatcaagtaaaaagacttcctggtgctcaggaattacagttcgttcttgaaacattccaaagaggccaccacagcttttcccatgtggcttcttttaaaaactcaaatggcttccttgaaaatactcaaagtccacccaaggaaattagtaataatagaatcagaaaactgtcaggagcataaagatttctgtatcaaaatgaaagaagcaatcctgagttgctgaattacccatctgctaatgaaaccgggatggactgatcatctaaccaagtgcagactgaggattctacttagtcctccgactgggtacaacaacagcctaggttctagggagggtggcagtgaccgggatgccacaatggaagagaaaatgaaaacactggcacagtgaaatgtctcatttccaaacagttttgcctatggccaagcaaggcaataaagacaaactctcccttttccccattgcgtgtgggctgccaggtacaagtaagggaatctttgctgtgcccactgtcctccagtagagaacccaacaggcaagggccccactcaggtatcagctcacctcctgcacctccccttagcaggaactccttccactggcaaaggactgccactgccatctgactcaactgtggcgatgtggacggagtcaccgagctgcttttcttttgcaaaacaaaagtctttttctttgcagtcacgctgtaagacgaggctgctggagaaaacaaaagcacctagatttcagtgctgaatccccacaattgcatgcagctcacacctaccaggggtattccagtgcataggggaaaggaacccggctgaaaaaccagctccttatttttcttttaaataaaataatacgatcctaagtccatttaccatctgaagttgtcacgagtgaacagtcacattactgttgtggaccaggccttagatgagtttctcaggctcagcactgacattctgggccggatcatcctctcttgtgggaccatcctgtgcactgcaggatgtttcacagcacccctggcctctacccactagaatcctacaatctaccagatcctaggatctagttgatcctagaatgctaccaaggagacttgaattttggtcccatcatcaaaaatgccttctgcatcaatcctatgccagtttcccctaaaagagggctaactggaatgttctaggatgtaccaatcctccaggaccctcttagagctcatgccatcagagacaggcctctatctcagggatcaccccggctgacatcaaattcctcttctcttttcccaacatttcaaattgttcttcggactcattgagttccctaaggtgacacgcccccccccccccccacacccaccttggggggtcacggattgctccctgtggccctggcttcagcccacctgctccatgaccctatgctcttctcctctggttctcgaagctgtctgtaaccagggcaggggagataactgtatgggaccattccctggcctccacctgccccagcactctccaggccagcacagtctggcactacagactacagggccggagacaccaggcttggaagtgaccactggccaagagctgacataaaagccaacttccccaaacaggaagggcctgttcttcacaaagataaagaaaactgccagcattttgctggccttaagaagccatgcaaaattaaccagtacatcatgaattaacttcttttactctgctgtgcactgaataccattatgaagcaatatacttttggattaaaaataagcatttttgtggaaaatctgctacatgttttcataaaataaagtgctatgatgtactaaaa

SEQ ID NO: 19948 - DNA, 8174 bp, Homo sapiens
  ENST00000310397
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacaacccacagcctcggcgcagctcgagaacatggaggaagcccccaagcgggtcagcctggccctccagctccctgaacacggcagcaaggacatcggaaacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgtataaaagagtctaccgagttcaccaagacatctgcttcaaagagagctgtgaaagcacaagcctcaagaagaccccaaacaggaaacaaagtaagagtcagacactggagaaatcttaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccacctgtgagtcctgcgatgcgtttaagcagcctgtgccctcacccaagctgcagttcctgaaggtgtagtctgtgtctctgcggatgagatgacagctcgccattccccggaatcagtgaggctgtcagtcagccacgcttctgcagtatgcagaaacctgttcttagactccaaagccagagaaagaattctcccttcgaggcccaacaaattgagaaggaactgtgatggaccacttccaaaacagagacgggggcaggggctgaagggcagagaccaggtgatgtcagaaggaaagccgggttgcagacacagccgcccctgctctggtcctccagcgtgtttatgacgctcgtgcaggtcgacgagccatcctatggactagttaacactaaggtggagttcagacttttttagacaacggcgcgactggcagcctttctctatcaagggtcagacggtaaacgttttcagctttgcagaccagaggtccctgtggctacagtagcgcagacacagccacaggcatgtcattgaatggctgcggctatgttccaataaaaacttatttacaataacaggtggtggccaaattggcccatgggccttatttggtgaaccctgttctatgagatcacctaggcttcagccttaaacagtggaagccatcccctgaatgacaagtcacaagggtatcaaagaaagacccctgaattttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccaccccacctcctctcgtgttgagcctcacgaccgctgacccagctggaaagccagcgccctgccgcgtcaccctgactctgctcagagccagcattccagccacaaagagggcctccttcctttcctctttcataaaaatgttttttgaagagttagagtatattttaggctttttatctttattaaaatttcatgtgcatgtgtctgtgtattctgcaatttgtcattttcagaaagaaggaacaggcaattcgcgaagtttcacctgtactcccgagctgttccccaggctccagacccacttgagagcagaaggtggagctcaatgaagggtctcgagctcagcgaagggtcactgggtgaactgagagaaaccacgttcacaaacgcgtactgcggacttcctgccgccctgggacctgtcactgtttgtccatgtaagctacagcattactagcagatgctaagatcgagtgatatcactggaaaagtaggtgaatcctactaggaaactttctactccctactaggacctcaagcccctcagccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagtgctgtcacaggacttgcccattgggatgttttccacattaaatatcaagtaaaaagacttcctggtgctcaggaattacagttcgttcttgaaacattccaaagaggccaccacagcttttcccatgtggcttcttttaaaaactcaaatggcttccttgaaaatactcaaagtccacccaaggaaattagtaataatagaatcagaaaactgtcaggagcataaagatttctgtatcaaaatgaaagaagcaatcctgagttgctgaattacccatctgctaatgaaaccgggatggactgatcatctaaccaagtgcagactgaggattctacttagtcctccgactgggtacaacaacagcctaggttctagggagggtggcagtgaccgggatgccacaatggaagagaaaatgaaaacactggcacagtgaaatgtctcatttccaaacagttttgcctatggccaagcaaggcaataaagacaaactctcccttttccccattgcgtgtgggctgccaggtacaagtaagggaatctttgctgtgcccactgtcctccagtagagaacccaacaggcaagggccccactcaggtatcagctcacctcctgcacctccccttagcaggaactccttccactggcaaaggactgccactgccatctgactcaactgtggcgatgtggacggagtcaccgagctgcttttcttttgcaaaacaaaagtctttttctttgcagtcacgctgtaagacgaggctgctggagaaaacaaaagcacctagatttcagtgctgaatccccacaattgcatgcagctcacacctaccaggggtattccagtgcataggggaaaggaacccggctgaaaaaccagctccttatttttcttttaaataaaataatacgatcctaagtccatttaccatctgaagttgtcacgagtgaacagtcacattactgttgtggaccaggccttagatgagtttctcaggctcagcactgacattctgggccggatcatcctctcttgtgggaccatcctgtgcactgcaggatgtttcacagcacccctggcctctacccactagaatcctacaatctaccagatcctaggatctagttgatcctagaatgctaccaaggagacttgaattttggtcccatcatcaaaaatgccttctgcatcaatcctatgccagtttcccctaaaagagggctaactggaatgttctaggatgtaccaatcctccaggaccctcttagagctcatgccatcagagacaggcctctatctcagggatcaccccggctgacatcaaattcctcttctcttttcccaacatttcaaattgttcttcggactcattgagttccctaaggtgacacgcccccccccccccccacacccaccttggggggtcacggattgctccctgtggccctggcttcagcccacctgctccatgaccctatgctcttctcctctggttctcgaagctgtctgtaaccagggcaggggagataactgtatgggaccattccctggcctccacctgccccagcactctccaggccagcacagtctggcactacagactacagggccggagacaccaggcttggaagtgaccactggccaagagctgacataaaagccaacttccccaaacaggaagggcctgttcttcacaaagataaagaaaactgccagcattttgctggccttaagaagccatgcaaaattaaccagtacatcatgaattaacttcttttactctgctgtgcactgaataccattatgaagcaatatacttttggattaaaaataagcatttttgtggaaaatctgctacatgttttcataaaataaagtgctatgatgtactaaaacctca

SEQ ID NO: 19949 - DNA, 578 bp, Homo sapiens
  ENST00000493358
aagccctgccaagcctggggccgcagtgaggctcgcaccgggacctgccccagactcgcctcccagccgcgagcatctaggctacgagaggggagaggggccgcatctccgcaacactgagtccccagagaacacgacagggcgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgc

SEQ ID NO: 19950 - DNA, 900 bp, Homo sapiens
  ENST00000401644
cagcctgccccatgtttcagacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactg

SEQ ID NO: 19951 - DNA, 816 bp, Homo sapiens
  ENST00000431690
gacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaaggtatggcgggcaggggcgtccgggccggcgtcagcaccctggagagcgcccgcggtccgccgtcctgcttctctgctgtctctctccttgtttcgcgaattgctgacc

SEQ ID NO: 19952 - DNA, 664 bp, Homo sapiens
  ENST00000420591
cagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacagttgtgacttgttagaggaattaaaaggccaactggagattgcagcctacagtataaaaatggctttcgtgtctgattgttgcacctgcctccagaggctcacccactgtgccgacttctgtggacgcaccaggtgctgcttctctccagggagatgctaaagacaaactattcaggttatttttagtttaaaaaattcaggaggaaattctgttttacccgtaagacacagagggtcatgggccctccatcagtctttgccgagtgcatgggaggccagggtgtgtcctgaggggagggtggggcaggagcgggaggaggcagcctcacctatttggctgctttaaagtcactgttccgtgtcacagctcactttgcccagattgttatctaaatatcaatgtatttcactaaattcatgtcaggaaacggataagtggtttcaaaaattttttgcaaataaaccgtgttttctaca

SEQ ID NO: 19953 - DNA, 963 bp, Homo sapiens
  ENST00000469006
agacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttg

SEQ ID NO: 19954 - DNA, 938 bp, Homo sapiens
  ENST00000483962
gaactgttaggacccagggaaaatgtggcaatgccaatgcaggtacagaacacacagaaatccagattgactgctggggaccctgatgtcacggcagatgagactcagctgcttcctgtcagatggggaatgcccgtgtgcaggagggagggagtgctgcgcccgctgcagtgttggggccggttctccacaggaagggcccagccattgccagagcctgggcagaaaagaggacaggcaagcaaagggcccacctgtgactgagttggggtctccagcctgtgagccccaccccagcccccaccatgtgtgcggacctgcttggcccctgctgcagccaggccccagggcttcgtcgagaaggccccaccagcaccagaggactgaggagatgccaggagggtatagtggctctgtggggccagcagcctggccccgttcatctgcctctctgtccttccacacagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagataggtaaggtgggtgggaggccaggccagggcggccaggggtgaaccctctctgcagatgtgaaaacaggcccatgggcagggctggtccaggccctggaggcgcaggaggtggagctgggtgcaggaggcaggatgccccacacagtcccgagccttcagggaagacacagtggccaggaccttcctgcattctggcagccccctccccctgcttccggagcccgtgtgtgaatggggg

SEQ ID NO: 19955 - DNA, 2198 bp, Homo sapiens
  ENST00000466618
gtggggctttgccagcaggcagtggaggtggcacgcctcccgaggaggggtgggtttggggctgatggaagaaaaagcacatgtcctgagtagttgctcccagctgggaaaggggtaactgaagccccaggaaatgcacggaatcctgggggcatgtgggcgcctcagacttgagccagcaacacccttgacaccccttctctgtgcagagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgtataaaagagtctaccgagttcaccaagacatctgcttcaaagagagctgtgaaagcacaagcctcaagaagaccccaaacaggaaacaaagtaagagtcagacactggagaaatcttaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccac

SEQ ID NO: 19956 - DNA, 4125 bp, Homo sapiens
  ENST00000491761
agggcatctggggaagccacaagcaccttggatgaccacggcccacgcacatgccccccttcccttctccaagcacggctgagtgtgaggggcaccacccatgccacaggggcagggacaggagcagagggcagccccagaccagccccttcctcctgcctgctctgcagcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacgtgagtgccagggcctccccacccaccttggtggcccaccctcgtcctcactgccactctcaccaggtcctgtcccctacatgatgagcccacccccaccgccagcgcagtctccagccagtgacccccaccccgactgtgcacaaggcgcggggctcgtgggccgccggcagcatgcacctccatggcaggaggggcagctcgtgagggcctcacgtcagtgtgtgggctggaggcgcaggctgctggtagggcacgcaagagaagataaacattttagaagcaggtctgagacattacagcagctttatttgccaaagtagggctctgagctttgttttagtaaaccatgggcaggaggccatgagggtctaacccgccactccgagtgtggtccggcaaatcctccgccactgtcctggcaagatcttcccggtggcagcaaggctgatgggcccaggtgccttgggcccttcccaccgggtttactgggtgagtgccgctctgggaatctgcctgtgattctgacacagaagccctgagacatgttggcaggagtgaggcaggcgcgaccctgccccagaggggacctctctggcccttgcctctcacctggaaggccaggtggtcatcctcatggaactccccaacagagcctagtcaccagtttaatgaacacgctctgagcaaaaactcctcaggcagaggagggagggaaatgcagcaaggagagtggcaagcagggaccagagccctggggtccctgccgcacggtgagcaggggagagagcccccagcaaggtgtctgaggagagggcaggcagctgcccgggatgcccagtggtgggcaggtgagatctggagtacagaggggggcccgttgtacttgcagctatggaagcggatatgaagtgcccgagggtgcggttgagatccctgcataagaagtgatgcagttgggggcgagggcatgaggaaggtcagtacagactgagggcagctcagaaagagcagggggtgccacagcctccaagaagcaggggtggaaggagaggaatgcagaatttgaccctaagaagaaagcaaccgcatcagccgtgaggatggggcctctcagcatgatcagtggtggctgtccctgaagcagctctgagggggccctgcaaggggaaggccgagcccctccagagggtcagcaggagggtgaggccagcccttcaggggaggcagctctggggccgacaggtgctggggccacgcagggagcctggtccccaccagggacatccgtgctccctgagatatagaagcactcaaaagggtggccccaggaccatcccgggtgcaaagcagctgcgccgtgtggtcaccgcctggcttctcctagaacccacagcctcggcgcagctcgagaacatggaggaagcccccaagcgggtcagcctggccctccagctccctgaacacggcagcaaggacatcggaagtgagtcagcagcgctggtggggactttgggactgactgactgctctcaggggccttagaggctgcaggcaggagggaccacccacggtgaggaatcaggaggcacagagcctacctgaggggaggctgagcaccaggcaccccggtgtgggaagatggggtgaagctacaccacccaagcagtgggaccccacagacgggaacaggccagggggcaggacccacccaaaccacccagagtctgagctagagagactggctttgatgctgcctcccctcccctctcctccttcgcctccacatgcagcagagcccaccccagcccctgcctctgggcccctcacccctcacttctccaaagaggagcaggcggagtcaggatgggagaagcagagggagcagccactgggcgagccccagcttgaggactagctgggccctgtggacactcaggttatgcaggacctgaactgtctcctagtccggggctctgcctcgtgaggatcgaggccagcacgtccctgcagggcaccaagcatctgctgagcacctgcagtaagagttcccagacgctcacgaggcagttccccttcgggcagcaccaatacatgtgtgttcctcaccctgagtcagactctacctttctcctggttctaatcctttggggctgtgtcctctatggacagctctcctagcacccggtgacctgttctcccctgagtcataccatagactcagattgggatcacccctcaacccaaccccaaagaagtcctagtacttggtaaaggtgtgagctgctgagcgtggtctcacccgcaaggccttgcccccagcttctcaaggacatgtgtacacatcaagggcacctgcggtggggtgtgtttgcaagtggcggtttcgctgaaccctaagttcaccatcccccccccgccctcaccatacaaggtctggacttgctgctagcccctgtgagcaccaggaggactggtttgtgcatccgacgcagagagtgaaggattctcttaattcaggtgtggcccattcagagtgaagactctcgtgttgatctttaagtgaactaaaacaaacatttcatcagatgatttgcattatgtcagcccctttaaataccaggtgttcatttcctagaactcagagattggaggggcgtgtgttaccctcctgggtctcttcagcaggagagattcaagatgacccccgggctggccctgaggtcaccacggtcatgtggtgtttgccagcacgagatgctcatgccctggtgggtgcaaaatgattttaagtgataacatgaaaagtagactctttaatggcccctcgatgcgcaaagccagtcatgatctttggttcatgttgcactctcacgctagctaccttttatttagttattagcctttgaataatgactaaatcaagaacccaacctataaacttggatgtgaacgataccttctatcttgccatcatactccctgttctctcccctcagttaaccatgatcctgaactttgtgcctagaattcctttgttttttcagagtggaaggtgcggggagtgattctatggtacatatatgtatggcagaacaataagtgagttttctttgcaagataattatcttgccatgtgtgatcgttagacctgtgttttcactccgcattctcggactgaggttggcccatgcggtctgggcggctgcggcttattcacacctactattgagcacagagtccactgagtgaactgaccggctcttctcccctctctgtgcagagaacatgtaggttgtgtttggtatgagcagtgctgcagtggatgttcctgtacaggttttccagtacgtgtgcgggagtggaaaagctggatctaggatgaggatgtgtgaatgcccaaattacatgagaactaagtcattttctaagaggcgatagcagtctgcgctccctccagcagtgatgaagacatgcagtgaatccagtctctctagaactaggttttgccgggtttgcagatcctacaggcagaacgggtgggatgcacacccctgggatctgggtttgcatctcctgggcactgatgtgactgcgcctctcctcatgggcatccaccaaaggtgtttgcttctgtgaaatgcctgatcacgccttttgactttatgttgggttatttgtactctttttattcatttgtcaaaattcttatatgttttgatactga

SEQ ID NO: 19957 - DNA, 1930 bp, Homo sapiens
  ENST00000342631
gtggggctttgccagcaggcagtggaggtggcacgcctcccgaggaggggtgggtttggggctgatggaagaaaaagcacatgtcctgagtagttgctcccagctgggaaaggggtaactgaagccccaggaaatgcacggaatcctgggggcatgtgggcgcctcagacttgagccagcaacacccttgacaccccttctctgtgcagagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgtataaaagagtctaccgagttcaccaagacatctgcttcaaagagagctgtgaaagcacaagcctcaag

SEQ ID NO: 19958 - DNA, 851 bp, Homo sapiens
  ENST00000623163
ggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctttagttgaatccatggacatgaaacccacagatatagagggttggcccggtgcagtggctcacgcctgtaatcccagcactttgggaggccaaggcgggtggatcacctgaggtcagaagcttgagaccagcctggccaacatgggtactgctttctcttgctgcagcttgcttcctccctcaggtatgaagttaagctactcgggaggctgaggcaggagaatcgcttgaacccgggaggcggaggttgccatgagccgagattgcgccactacactccagcctgggcaacaaaagcgaaactccatctcaaaaaaaaaaaaaaggcatataaaattatagctgggtaggaggaataagttctagtgttctacaccactgtgggatgactatagttaacaataatacatactttcaggtaacatgaaggaggatattgaatgttcctaacacaaagaaatgataaatgtttgagatggtggatgtactaattgccctgatctgatgactatacattatatatattgaaacatcagtatgtaccccatgaatatgtacaattatatgtcaacttaaacacatttaaaagtaaaaaaaaaaaaa

SEQ ID NO: 19959 - DNA, 711 bp, Homo sapiens
  ENST00000623901
ggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctttagttgaatccatggacatgaaacccacagatatagagggttggcccggtgcagtggctcacgcctgtaatcccagcactttgggaggccaaggcgggtggatcacctgaggtcagaagcttgagaccagcctggccaacatgggtactgctttctcttgctgcagcttgcttcctccctcaggtatgaagttaaggtaacatgaaggaggatattgaatgttcctaacacaaagaaatgataaatgtttgagatggtggatgtactaattgccctgatctgatgactatacattatatatattgaaacatcagtatgtaccccatgaatatgtacaattatatgtcaacttaaacacatttaaaagtaaaaaaaaaaaaa

SEQ ID NO: 19960 - DNA, 568 bp, Homo sapiens
  ENST00000589187
cttttacgtcggccttcgcgagcgtctgggcgggtggtaggaacaatggcgctgtcttcagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctttagttgaatccatggacatgaaacccacagatatagagggttggcccggtgcagtggctcacgcctgtaatcccagcactttgggaggccaaggcgggtggatcacctgaggtcagaagcttgagaccagcctggccaacatgggtactgctttctcttgctgcagcttgcttcctccctcaggtaacatgaaggaggatattgaatgttcctaacacaaagaaatgataaatgtttgagatggtggatgtactaattgccctgatctgatgactatacattatatatattgaaacatcagtatgtaccccatgaatatgtacaat

SEQ ID NO: 19961 - DNA, 753 bp, Homo sapiens
  ENST00000622963
ggtcttttacgtcggccttcgcgagcgtctgggcgggtggtaggaacaatggcgctgtcttcagtggcacagtggagcagctctgaagatgcaaagtgagggtcgctgtctgcccattgatagaggccagattgtcttggaagttccaaagttgcaacgatttctttagttgaatccatggacatgaaacccacagatatagagggttggcccggtgcagtggctcacgcctgtaatcccagcactttgggaggccaaggcgggtggatcacctgaggtcagaagcttgagaccagcctggccaacatggtaaaaccccatctctactaataatacaaaacaatttgctgggcatggtggtgcacgcttgtaatccaagctactccagaggctgaggcagaagaatcgcttgaatccgagaggcaaaggttgcagtgagcccagatcacaccactgctctccaacctgggcaacaagagcaaaactccgtcaaaaaaaaaagatacagggtcaactgtacacattaaacacttctatcaactagtgatgtcagtcttgtccattgtattattgcctatcttactaaacagtcatatttcaggaagtacaatatactcaaaaactaagttaatgttctttgtagatttatggttaatggatgattcatataatagaaacttaaatttatttgaccattctatttaatatagaataaatacaactagccaggcatggtggctcatgtctataatg

SEQ ID NO: 19962 - DNA, 886 bp, Homo sapiens
  ENST00000623650
ggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagttagttgaatccatggacatgaaacccacagatatagagggttggcccggtgcagtggctcacgcctgtaatcccagcactttgggaggccaaggcgggtggatcacctgaggtcagaagcttgagaccagcctggccaacatggtaaaaccccatctctactaataatacaaaacaatttgctgggcatggtggtgcacgcttgtaatccaagctactccagaggctgaggcagaagaatcgcttgaatccgagaggcaaaggttgcagtgagcccagatcacaccactgctctccaacctgggcaacaagagcaaaactccgtcaaaaaaaaaagatacagggtcaactgtacacattaaacacttctatcaactagtgatgtcagtcttgtccattgtattattgcctatcttactaaacagtcatatttcaggaagtacaatatactcaaaaactaagttaatgttctttgtagatttatggttaatggatgattcatataa

SEQ ID NO: 19963 - DNA, 672 bp, Homo sapiens
  ENST00000624128
cggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagttagttgaatccatggacatgaaacccacagatatagagggttggcccggtgcagtggctcacgcctgtaatcccagcactttgggaggccaaggcgggtggatcacctgaggtcagaagcttgagaccagcctggccaacatggtaaaaccccatctctactaataatacaaaacaatttgctgggcatggtggtgcacgcttgtaatccaagctactccagaggctgaggcagaagaatcgcttgaatccgagaggcaaaggttgcagtgagcccagatcacaccactgctctccaacctgggcaacaagagcaaaactccgtcaaaaaaaaaagatacagggtcaactgtacacattaaacacttctatcaac

SEQ ID NO: 19964 - DNA, 1029 bp, Homo sapiens
  ENST00000587692
cttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctttagttgaatccatggacatgaaacccacagatatagagggttggcccggtgcagtggctcacgcctgtaatcccagcactttgggaggccaaggcgggtggatcacctgaggtcagaagcttgagaccagcctggccaacatggtaaaaccccatctctactaataatacaaaacaatttgctgggcatggtggtgcacgcttgtaatccaagctactccagaggctgaggcagaagaatcgcttgaatccgagaggcaaaggttgcagtgagcccagatcacaccactgctctc

SEQ ID NO: 19965 - DNA, 1032 bp, Homo sapiens
  ENST00000369605
ggtcttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaccagccttgtaatcaaa

SEQ ID NO: 19966 - DNA, 680 bp, Homo sapiens
  ENST00000427501
aatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgga

SEQ ID NO: 19967 - DNA, 696 bp, Homo sapiens
  ENST00000435947
ggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgga

SEQ ID NO: 19968 - DNA, 632 bp, Homo sapiens
  ENST00000624295
agggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagactaaatcaaattttttttgtcagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttgg

SEQ ID NO: 19969 - DNA, 257 bp, Homo sapiens
  ENST00000625175
ataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagggctagtgccacgaggtttacttgactgttgtgtgaaaagctgataagaaaaccatccagaaaaaagctcttcgttttacaaacatgaaaataaaacatgtaattttg

SEQ ID NO: 19970 - DNA, 631 bp, Homo sapiens
  ENST00000623910
ggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttg

SEQ ID NO: 19971 - DNA, 641 bp, Homo sapiens
  ENST00000428833
ggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttg

SEQ ID NO: 19972 - DNA, 401 bp, Homo sapiens
  ENST00000453754
cacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggaacaatggcgctgtcttcagtggcacagtggagcagctctgaagatgcaaagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttg

SEQ ID NO: 19973 - DNA, 1002 bp, Homo sapiens
  ENST00000420199
gccttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttg

SEQ ID NO: 19974 - DNA, 430 bp, Homo sapiens
  ENST00000414002
cttttacgtcggccttcgcgagcgtctgggcgggtggtaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttg

SEQ ID NO: 19975 - DNA, 374 bp, Homo sapiens
  ENST00000623267
tggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagggctagtgccacgaggtttacttgactgttgtgtgaaaagctgataagaaaaccatccagaaaaaagctcttcgttttacaaacatgaaaataaaa

SEQ ID NO: 19976 - DNA, 598 bp, Homo sapiens
  ENST00000623001
tggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaagtagtgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatg

SEQ ID NO: 19977 - DNA, 998 bp, Homo sapiens
  ENST00000431043
cttttacgtcggccttcgcgagcgtctgggcgggtggtaggaacaatggcgctgtcttcagtggcacagtggagcagctctgaagatgcaaagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaa

SEQ ID NO: 19978 - DNA, 388 bp, Homo sapiens
  ENST00000433843
atttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttga

SEQ ID NO: 19979 - DNA, 489 bp, Homo sapiens
  ENST00000425170
gggttttgtgtggaaaaacgccttggagtgtgacatttctgcgagaatgcttaaataccgatttcccgcaggaacaatggcgctgtcttcagtggcacagtggagcagctctgaagatgcaaaggtaagagcttagttaagcttagtttccaaactaaaggagtaaacctgttgatttacaggaataggaactgttgcatcgtttgaaatttacttttttttgttagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaatgagggtcgctgtctgcccattga

SEQ ID NO: 19980 - DNA, 5164 bp, Homo sapiens
  ENST00000395601
gtgttgtgtttggagagagggtagacagcagtgggaaggggacgtaactgagaagcatgaaacaccttgagtggaccatgagacctgcttagagttaggggaaagcttgagaggttcaaggatagaagaactcagggtggttcaggtgtgacatgggttatgtgggcatttctggattgctctgggaaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctattgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaatatgatttctttatcacttaagctttgggctgattaatatctgtgtgggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgca

SEQ ID NO: 19981 - DNA, 2273 bp, Homo sapiens
  ENST00000517992
cttgctttggggttttgcaactggctgctggcttttttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgtt

SEQ ID NO: 19982 - DNA, 1962 bp, Homo sapiens
  ENST00000519177
ctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccagtcctcatccgtgaacattatcttcagattctgagacattcccgcaacagaaaccaaagaaagattagaccacagtcactggattccagttactaagaagcaaagttggacccaagcatcttgaaatgattctcagaaacaaaagttgaaataaggtagtttctgcaactctcaggcaacatgaaaataaaatttaccctcgtacatagccttgttctcacagtttctgggcattatgaacaatggggactgctttttcattcattcattcattcatcagtcaacatttataaatcatctactatgtgccaggagttataattgggacaagggataaagaggtgaaaaaaattcaaacttgtgaacctagcattatctggaacaaagtgtgttgatgtgcaggaacacataaggaaccatttgcagtaaagacaacaaaaaatgccaaactctgcctggacagtggtggaggactccttgcagtagaagtcatgttgaattgaagcctgagggaaaactcaccagaggaacaagggaagggagcccagagaggggcatgagcattccagacttagggaagatccaagcacagagctcgtgcactgctgcatggcccagttagagcaccacatacggccctggggaatgaggggaaatgaatcagatactcactaagtacccagcacttgacacaagttaccacttacaacgtgtgtatccattctgcaaggccggtattagtgtgcccattttgcagattaggtacctgaggctcaaaagagttcaggaatcaccccaggtggtgtagcttctgagagatggaggtgggattccagttccgggactgtgtgtcacttgcatacctgtgccttggtaccacagggggttgacacagaggtgggagatggggaggaagacttttcactagcgtatccttttctaccttttgaaattggaaccatggggaacagcaggagtctttggggatgataagagtcatggatgtgatctgggtagatatttttatatttggtgtcaaataacaaatgtccaaggagtgactgctgaatccaattttgcagtgatcctgattccattgtaaagaaa

SEQ ID NO: 19983 - DNA, 414 bp, Homo sapiens
  ENST00000519298
tgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacagccataggaatcacagatttgaggaactgaaggcgaccataatgaccatgtggtttgaattctcctggattccccgaagttgctgcaagccagcaagacttcatcctcctgactagtttcatctgtgttttctccagagtcacttggaggggaaaggcagcttgaaatccactctccagatgctaagcacacggtgat

SEQ ID NO: 19984 - DNA, 559 bp, Homo sapiens
  ENST00000520717
aacatttgtccctggggtctgaggcaggcatgacctgttgaaaaccccaggccagcagagacacctgtccagggctcgatagaaaacatttcttgcatttaaggacaggaggtttaagccactcgggctacgttgactcttcattctagaatcttgggacagcgtattcccttttaactcctggggagcccagggccttggtctgagtttagcttcctccagggaacccgggtggaaaggagagacaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttt

SEQ ID NO: 19985 - DNA, 3713 bp, Homo sapiens
  ENST00000557789
ccgctccgggagagttagggctccgagccgagcgcgcggagcagctggggccggggcgcggatgctggaagttcacatcccgtcggtggggcccgaggccgaggggcccaggcagagcccggagaaaagccacatgatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccaggtgaggaggtgcctagatatggggctacagggctgggttgtgggctttgcatttctcggctcctgggaccctcagacagcatctccttcctgctgcccacctctggagccactacctcctgctcctgtcccctggagcctgctttgtagacacaaggaaaacaagtttggcttccctggtctccatttcttcagcagcctgacttctttaccaagctgatgtgaaaagaatgtgacctgggaatgcggaggcttcatttggggtggacagctgctgtctgctgccttggcaggggctcctactcccaagtgggggctgagcccatgagcaggagctcaaggagctgcaggtctgaggccagacctgtttaattctatcccacagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagccgggcattgtggcatccgccaccatgcccggctaatttttgtatttttaatagagatgggtttcaccacgttggccaggctggtcttgtactcctgacgtcaggtgatccacccgcctcggcttcccaaagtgctgggattacgggcgtgagccaccgtgctcggcccaaggcaggagaatctcttgaagccaggaggcggaagttgtggtgagccgagatcgcgccactgcactccagcctgggcaacaagagtgaaactccgtctcaaaataaataaataataaaggaagaagtcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaacccacatttttttttattggtcagtgttggtaggagtttgttacaaaagtgagtccatgggcctgtggaatgtgaggggagtgggtccgctccaccagatgccagcaccggggccagtgcagctcagagccctgtggcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttccgcaccacctcctggaaaagaaaggtggaagcaggagggcatggtggatcaggaggtccaccgctcaggagaaaggccccagcgtatggctcaggagggctaagacccacaagtgatcaacagcacacaaaactggaggcaccaaaattctaacagactcctggccagagcagggagaatgcagatttgacgagggggtacaggaattttgttcctttgaagtaagacccaggttgggccaagggtgaggaggaggaagagggtgaccagggcatgtggcttctcagggacattgcgttcagctgcactctgtatacctcaggggtgggaccagcacgtcactgagtgaaggaggggagggaggctctggcagttgtgcagccttcctggctgggctctgagggggctggaagaatttagaaccttggaggcatggaggtacagggtttattctggacaggagcactgggctgcatctgtgggttgggtccttttgggaaagggatggacacatggagctcctgccctggggtctgtgttgaatccccggtgaggattgcccagtagtagcccttgcttccacaactcaccatgccctctagaactttgccaaacaccacatgcttgccatctagccaggctgtcttgactgtcgtgatgaagaactgggagccgttggtgtctttgcctgcgttggccatgctcacccagccaggcccgtagtgcttcagtttgaagttctcatcggggaagcgctcaccgtagatgctctttcctgggaaaaaagacagagcaggtcaggggcgctggattgcgccaaaccaagcagacattcggggccaggactgagggggcttaacctgtcctctgtgccaggctaggctggagtggactacaaggacataaaagcagcgtccttcctatcttctggcctcagagccaagccatgctgactgaggccaagtggggcatcaggccaggctgatgtggtgaacagctcacagaaggattactttgagaagatagttttgtggcttttaaataaggcgcatgttatcagctccccttagctatggcccaggcctgccacggagggactttggtggagggaagtgccgtgcaggatgcaggggagtcaacagggtcggaactctccagaaaaggaggactgctgtggctgaccagcctgttttcctatgagcacaaaagacacaggcatagctgcagaggagaaagcagccagagatgtgtggggaggggcagaaaagaggggctgccccttggattctggagagtcaaagcctcttaacaaggaatgaacaggaataaaagacagctgtgagtgtg

SEQ ID NO: 19986 - DNA, 3614 bp, Homo sapiens
  ENST00000325881
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagccgggcattgtggtggtgcatgcctgtaatcccagctactcgggaagctgaggtaggagaatctcttttttttttttttttttttttttgagacggagtttcactcttgttgcccaggctggaatgcaatggcacgatctcggctcacggcaacccccgcttcccgggttcaagcaattctcctgcctcagcctctcgagtagctgggattacaggcatccgccaccatgcccggctaatttttgtatttttaatagagatgggtttcaccacgttggccaggctggtcttgtactcctgacgtcaggtgatccacccgcctcggcttcccaaagtgctgggattacgggcgtgagccaccgtgctcggcccaaggcaggagaatctcttgaagccaggaggcggaagttgtggtgagccgagatcgcgccactgcactccagcctgggcaacaagagtgaaactccgtctcaaaataaataaataataaaggaagaagtcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaacccacatttttttttattggtcagtgttggtaggagtttgttacaaaagtgagtccatgggcctgtggaatgtgaggggagtgggtccgctccaccagatgccagcaccggggccagtgcagctcagagccctgtggcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttccgcaccacctcctggaaaagaaaggtggaagcaggagggcatggtggatcaggaggtccaccgctcaggagaaaggccccagcgtatggctcaggagggctaagacccacaagtgatcaacagcacacaaaactggaggcaccaaaattctaacagactcctggccagagcagggagaatgcagatttgacgagggggtacaggaattttgttcctttgaagtaagacccaggttgggccaagggtgaggaggaggaagagggtgaccagggcatgtggcttctcagggacattgcgttcagctgcactctgtatacctcaggggtgggaccagcacgtcactgagtgaaggaggggagggaggctctggcagttgtgcagccttcctggctgggctctgagggggctggaagaatttagaaccttggaggcatggaggtacagggtttattctggacaggagcactgggctgcatctgtgggttgggtccttttgggaaagggatggacacatggagctcctgccctggggtctgtgttgaatccccggtgaggattgcccagtagtagcccttgcttccacaactcaccatgccctctagaactttgccaaacaccacatgcttgccatctagccaggctgtcttgactgtcgtgatgaagaactgggagccgttggtgtctttgcctgcgttggccatgctcacccagccaggcccgtagtgcttcagtttgaagttctcatcggggaagcgctcaccgtagatgctctttcctgggaaaaaagacagagcaggtcaggggcgctggattgcgccaaaccaagcagacattcggggccaggactgagggggcttaacctgtcctctgtgccaggctaggctggagtggactacaaggacataaaagcagcgtccttcctatcttctggcctcagagccaagccatgctgactgaggccaagtggggcatcaggccaggctgatgtggtgaacagctcacagaaggattactttgagaagatagttttgtggcttttaaataaggcgcatgttatcagctccccttagctatggcccaggcctgccacggagggactttggtggagggaagtgccgtgcaggatgcaggggagtcaacagggtcggaactctccagaaaaggaggactgctgtggctgaccagcctgttttcctatgagcacaaaagacacaggcatagctgcagaggagaaagcagccagagatgtgtggggaggggcagaaaagaggggctgccccttggattctggagagtcaaagcctcttaacaaggaatgaacaggaataaaagacagctgtgagtgtg

SEQ ID NO: 19987 - DNA, 2789 bp, Homo sapiens
  ENST00000561334
gagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcgggtgaggcggcgccgacctcccaccggccccggcccagcctctgtccagcccccgcccaggccctgtgaggcgggcgggcgagccccagcctccgccacccccattactgcctcagtccctgcgcagccggtcagcccccgggcctctgtgggtgggttggggccttcctcgccctcggccggtccaccactcaccagggtctgtcccagtagagcccgaaggcgggggcgcgggagggcttctggctggggcgaagagggcttgagggctcagtcgggatgctgtgatcgcacgcggtaaacctccagtagatcaagaagctgtacaaagtgcccgacttcccctcgaaacgcctgcccaactggaggaccagagggttggaacagcgccggcagggcttggaggcttacatccaggtatgcgagagcacagttggttgccccccggccttctgtgccaggggtgtggcccagacagagaggtgtgggggcatggcagggagggaacccacaacttggggatgttattcaccacctcaagcatcaattttctgagtctaatataggtccaaacacccccctctggcttgttgaaaggactgaaagaggtaacggacacaggtagtcccagctccatgaaacccaggtcctgtcccctccatggtgaggtcctgtgctgccctcctgatggcatgtagggtgagggtccttcccccaacagcaaagctatgccgcgtcatggggtacaacctgtgcacacagcgcccagcgcccagaagggccctgagcctggttcaacgctctgctgtcattgtcgtgaaattctttttttggaacaaagagccctgcattttcactggcactgcgctatgcaaattagtagctgggtctgattgcaggtctcctctgtcctctccagggcatcctgtacctgaaccaggaggtgcccaaggagttactggaattcctgagacttcggcacttccccacagaccccaaggctagcaactgggggtaaggggggccgatggcgggggccaggggctgtcagcagtgagcaggtgaggaaaggtgttggagggcaagccctttcttttcacatctgccaggatccagcatgaccgccctcaccagctctcttgacctgggtggaggggcttttttttggacagacttggttacccccgccacctccggaactggggcttgttacaaatagaagcagtggtcccctgggaggtgcagttctgggctctggtgtctccaccccttcctcacgctcccccggcatccccaggcagcttacagtgtttctcttctcttcagcaccctgagggagttcctgcctggcgacagcaggcaagtcaaagccctagcccgcgcttggcccctgctgccccctagtggccatatgctaggaggcaggcctgctgcctgggcctgtctggcctgggccctgaagtctgttttccctttggtgcctcctgagcccatttcccactcaccttttccttcatgggtccctggtgatggcaaccccgtctccacccctctgtgggattctgccctgcctcccgcacccatggttcatgaccctgtttcctcccagctcccagcagcaccagcggcctgtcctgagcttccatgtggatccctatgtttgcaacccctccccaggtgaggaggtgcctagatatggggctacagggctgggttgtgggctttgcatttctcggctcctgggaccctcagacagcatctccttcctgctgcccacctctggagccactacctcctgctcctgtcccctggagcctgctttgtagacacaaggaaaacaagtttggcttccctggtctccatttcttcagcagcctgacttctttaccaagctgatgtgaaaagaatgtgacctgggaatgcggaggcttcatttggggtggacagctgctgtctgctgccttggcaggggctcctactcccaagtgggggctgagcccatgagcaggagctcaaggagctgcaggtctgaggccagacctgtttaattctatcccacagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagccgggcattgtggtggtgcatgcctgta

SEQ ID NO: 19988 - DNA, 1353 bp, Homo sapiens
  ENST00000558466
gagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactgggggtaaggggggccgatggcgggggccaggggctgtcagcagtgagcagcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaatcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaa

SEQ ID NO: 19989 - DNA, 1182 bp, Homo sapiens
  ENST00000560607
gccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcgggtgaggcggcgccgacctcccaccggccccggcccagcctctgtccagcccccgcccaggccctgtgaggcgggcgggcgagccccagcctccgccacccccattactgcctcagtccctgcgcagccggtcagcccccgggcctctgtgggtgggttggggccttcctcgccctcggccggtccaccactcaccagggtctgtcccagtagagcccgaaggcgggggcgcgggagggcttctggctggggcgaagagggcttgagggctcagtcgggatgctgtgatcgcacgcggtaaacctccagtagatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccagg

SEQ ID NO: 19990 - DNA, 1807 bp, Homo sapiens
  ENST00000560945
gagcgcgcggagcagctggggccggggcgcggatgctggaagttcacatcccgtcggtggggcccgaggccgaggggcccaggcagagcccggagaaaagccacatggtgagcgcggcccctggatggggaggggcgccgggacccgcaggatttccccgcgctgcgctcagtggggacccggggcccgggcctgggtgaacgagcgctgcgggctggaccgtcgggggaaaccttgtcgagggtttgggggccgcttggatttgccagcctcgcggaccatggttcgagctcttgagggaccccagggctccgaggggcaggtccgccagccggttctcccaggtgtgcgggagcggagagtccccgggcagccgcggcgccgcaaggccgctttgtgcctttgagagcgggagggtgggcacgtcgccaggcgcaggtgctgcggcgtcctcccgcggggcctcacgcgcagacccgctgcccgcccgcgccgccaggtgttccgagtggaggtgctgtgcagcgggcgcagacacacggtgccaaggcgctacagcgagttccacgcgctgcacaagcgggtgaggcggcgccgacctcccaccggccccggcccagcctctgtccagcccccgcccaggccctgtgaggcgggcgggcgagccccagcctccgccacccccattactgcctcagtccctgcgcagccggtcagcccccgggcctctgtgggtgggttggggccttcctcgccctcggccggtccaccactcaccagggtctgtcccagtagagcccgaaggcgggggcgcgggagggcttctggctggggcgaagagggcttgagggctcagtcgggatgctgtgatcgcacgcggtaaacctccagtagatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccaggtgaggaggtgcctagatatggggctacagggctgggttgtgggctttgcatttctcggctcctgggaccctcagacagcatctccttcctgctgcccacctctggagccactacctcctgctcctgtcccctggagcctgctttgtagacacaaggaaaacaagtttggcttccctggtctccatttcttcagcagcctgacttctttaccaagctgatgtgaaaagaatgtgacctgggaatgcggaggcttcatttggggtggacagctgctgtctgctgccttggcaggggctcctactcccaagtgggggctgagcccatgagcaggagctcaaggagctgcaggtctgaggccagacctgtttaattctatcccacagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaatta

SEQ ID NO: 19991 - DNA, 3367 bp, Homo sapiens
  ENST00000560997
gggcttttttttggacagacttggttacccccgccacctccggaactggggcttgttacaaatagaagcagtggtcccctgggaggtgcagttctgggctctggtgtctccaccccttcctcacgctcccccggcatccccaggcagcttacagtgtttctcttctcttcagcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagccgggcattgtggtggtgcatgcctgtaatcccagctactcgggaagctgaggtaggagaatctcttttttttttttttttttttttttgagacggagtttcactcttgttgcccaggctggaatgcaatggcacgatctcggctcacggcaacccccgcttcccgggttcaagcaattctcctgcctcagcctctcgagtagctgggattacaggcatccgccaccatgcccggctaatttttgtatttttaatagagatgggtttcaccacgttggccaggctggtcttgtactcctgacgtcaggtgatccacccgcctcggcttcccaaagtgctgggattacgggcgtgagccaccgtgctcggcccaaggcaggagaatctcttgaagccaggaggcggaagttgtggtgagccgagatcgcgccactgcactccagcctgggcaacaagagtgaaactccgtctcaaaataaataaataataaaggaagaagtcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaacccacatttttttttattggtcagtgttggtaggagtttgttacaaaagtgagtccatgggcctgtggaatgtgaggggagtgggtccgctccaccagatgccagcaccggggccagtgcagctcagagccctgtggcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttccgcaccacctcctggaaaagaaaggtggaagcaggagggcatggtggatcaggaggtccaccgctcaggagaaaggccccagcgtatggctcaggagggctaagacccacaagtgatcaacagcacacaaaactggaggcaccaaaattctaacagactcctggccagagcagggagaatgcagatttgacgagggggtacaggaattttgttcctttgaagtaagacccaggttgggccaagggtgaggaggaggaagagggtgaccagggcatgtggcttctcagggacattgcgttcagctgcactctgtatacctcaggggtgggaccagcacgtcactgagtgaaggaggggagggaggctctggcagttgtgcagccttcctggctgggctctgagggggctggaagaatttagaaccttggaggcatggaggtacagggtttattctggacaggagcactgggctgcatctgtgggttgggtccttttgggaaagggatggacacatggagctcctgccctggggtctgtgttgaatccccggtgaggattgcccagtagtagcccttgcttccacaactcaccatgccctctagaactttgccaaacaccacatgcttgccatctagccaggctgtcttgactgtcgtgatgaagaactgggagccgttggtgtctttgcctgcgttggccatgctcacccagccaggcccgtagtgcttcagtttgaagttctcatcggggaagcgctcaccgtagatgctctttcctgggaaaaaagacagagcaggtcaggggcgctggattgcgccaaaccaagcagacattcggggccaggactgagggggcttaacctgtcctctgtgccaggctaggctggagtggactacaaggacataaaagcagcgtccttcctatcttctggcctcagagccaagccatgctgactgaggccaagtggggcatcaggccaggctgatgtggtgaacagctcacagaaggattactttgagaagatagttttgtggcttttaaataaggcgcatgttatcagctccccttagctatggcccaggcctgccacggagggactttggtggagggaagtgccgtgcaggatgcaggggagtcaacagggtcggaactctccagaaaaggaggactgctgtggctgaccagcctgttttcctatgagcacaaaagacacaggcatagctgcagaggagaaagcagccagagatgtgtggggaggggcagaaaagaggggctgccccttggattctggagagtcaaagcctcttaacaaggaatgaacaggaataaaagacagctgtgagtgt

SEQ ID NO: 19992 - DNA, 8008 bp, Homo sapiens
  ENST00000308527
ggaatcgcctttttgttttggagctgccttctcgctggcggagcggagggtctgcgagcgccggggaaggcaggctgggggcgcagcccgccccccactggccgggccccgcagggcggagaggaggacggacggacagacggctggccgcgccatctgctcgccggagctcactctccaaactccaaactgttgagtgtgtgcgtgcacgcgagggtggtgatcgggggtcgtaagtcccgggtgaggaaccggtttctgctggggttacctttggacggggttcctgggattcagagcagggtcagcgtcaggctcagaaactgctgaggaattaggcaaacaaaagagaccactcagcgagtggctagaagtcgcccgacagcctcgtcgcgccccctccttcctccggggttggggctggccacttctggggcggggagagggcgcccgagccggcgggggctccggctgcgcagccggggtcgaagagttggcggcctgttgtgtaagcctcagtccttgttttcccggcctggctcgttgtgaagccggacacatccacccttggactcgattcaggcggctgctgcttttctccttgcccctcttggattttccggatttttgaaaacccagtggcccaggagcaagaggaggaaggaggaaggggcagatctgcagaggaatgtgagagcctcccaaagcgagagccgccaaaagaatctgggagccagagggacagccgagccctgcccgggtttctggaatggtggtttcagagtgagtctcttctattttagaacgttgttccagtggaaagtgtcgaatttttcccctcgcagggcagatttctccaggtcacttgacttttcttctgggagtaggagttaggagagattcccctctaaccccccagaggctgctaagggaggaggagactgtggacatgagccctccctgctcacaagcatatgcccggagacctgatagggcagtttctgggccatggacattgctttgaagagggggagactggacagcatctgtgggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagataacacaagcatgactttttctgtttggatcccagaaaggcggagggcaggagaaggatagagccctaattgctcctgagagccattggatgagattctgaggtcgtggtgggcacaaattttccacagaacctcaaaagttcaggggagggctatgctggtggaaggtgccagcaggcaggaggagctagaggcggctgtggacccctgggtggatccatccctccctagaacgcactcttgtctctaaaacaggtggagtgctgcccaggggactggctgtactgccttgtgatctggggctgagggttgtatgaggaagggacaggacgctgtgccctaggacaattaatagatggtggctcctctccccaaggagccatgccctggccttgcccttgaaaagccctagtccaggggagggaagtgggggactcagaagctgtgtctcttccccaaaccgtcctgggtacccagccctgcggaggctcccacattggaaactgaagaggacgctggctgttgggggtgccctgatcaggatgagcggaccttgctcttggatctgttcatccacagatgagaggagggtactggttgagacttggctctcctttggaggcaatggggacttggtggagggagggcttccagggtcaaggccgtcagggaaggttggctagaccagggaccagggagcttgtgcaggaagatggagaagggccagcaggtgcggtgggggaaggggcgggcaggactccctgttcagggcatagcgtcctcagaggaacttctggaatgggtccccctggcccttggtcaacattaggtcagatttgggactttctgaggaattttcccctctctccaccctgccccattttctaacccatccgaggaacttcccgcccttaacctcttctcagctctgccatccatgtagccatctgcagaaggggctctgagcagtgggggctgggccaggccgaggcagggctggtgggaatgctcctcctaacccatggtgcctggaaagtcccctgctcatgcttcctgctctgggaacagtgttgtcctctgtgtgccttccttgagaggggaccacctcccaggccttccatcctcagggtgaggccatcagtctgatacttttctcaggagggacttggatccaggagaagcatcaggaagtggagtcttgggataatgccaggcctgctcctggtatcctgaggtctctgggctggggcaggtgtgtgtgtggcagggagggaggctgtcctggccctcctctctcttttctttctgcctctatgggggtgggggtattgggggaacttggggccgttctggggtagctaagcccctttcagcaggagattgggggaccagtgttgggggcatcctggtgatggccgattcctgcctcgtcacatgccaggcagatgttcccgactcggctggacccagctgcctcgtttcctcccttactttgctctgagggggtggaaaacaaggcttctctttctgccctggacagctaccagcacccggggtaggggatcccctggtcaccagtcttggcccagtacaggaaaaggaatccgctttgtggccacagatgggggctggggatggaagcagacctcagatcctgcatctcttcacccgctggacacaggagggctatgaaccactgtgccgtggctgcaccactggctggagcagagccaggcctgggagaggcaggtggccccatcggcccctgctctgcaccacccctcccagatgacagagccatatgtcttccacgtgtctacacactcacagactcacgaatgtaatcgctcagtctcacaacaagcacacgcagtcacacacctgcccacaggcacatacgccacataagcatgcctgtatgctcacacagtcatactgccacacgctattacacattcacagccacagccacacatgccttgccatccattcaaagcaccagtggctactttgtcagacacagccacaccacagtcctatgcacatggtcatagcctcacacagtgacacatactcgggcacacaccgccacaaagccatgcttgcacagagcaaaggtgtcataagcatctctgtgcctggactgcacctgcatgacctcccagggtccccacctcatcagagattaaggagagctttgcttggagacaccacccctggagggggtgtctccaagggggagtagagccagtcacaagcaccacatacaggcacacagcctgaggtctagggatgcaattgggatgactggataccaccaagttcagctccttattgaacagatgggcgcctgaggcccagggagcagtggtggctggccttatcacccagcagggcaggggatactctggggccagagcctggctctgggcagactctgtttcctggccctgccctcccctgggccaatcctctgggccaggctgcctctgaaggcccctggctgaaccgatccagcagagctccaggcagctcccttctcaagctagagctgagctgcagtggccacgggagccggagccaggatgcggtgggcagggcctaggcctgggcgggaggaacattcctgcaccatctcctccccaagcatgtgaggacccagcccgccctgcccgcctgcccgctgactcaggcctccaggagccaagcctgctcagctcccccacccaccctaacctgcttccccactagttcggctctggttcccctctccactggctggggcaggagaagacggtgagccctggtaggaagaccatggggaaaaatcaaacctcaccaccccccgacatagctcagaagggctgattgtgaaacccagctctgttcaacatagttgaacacaaactttttttttcttttggtttggttttgttttgttggtcaaaccccagtgcagtgcagtctgtttaagaagtagtgtcgcatagctgtggcctggatctgctcagcagccccagtaggcagcatttattccctttcgcaacaaagagactgagacttggccagagggaagatgggacctgcctaggttcacacagggaatctctggcggggctggactcaaacccagctccctgccatcactccttagagtcacactgatgaactcatttagggccaaaggaagaaggggaggcagatttcccctctagatgagtgaagggataggaggctggtgaacccaacggctgaaatgtgaagggtgagagggtagggtgagtccccccagccctgagggatgaagggtctgaagatggcactgcacggtgacagctgcagtgactcaggagctccgtttacaaaggaacatgagtgaggaacataacttaatttttttttatatctgacctgaatttctgttttcctcccccattccccacatggtagaagtgtaatctcacatcaatttggggaccctttctttccccagggatgtgtagaacttttggggatggcacatttgaagaccttagggagctttgcattttaaaggctgaatcccacactctatcatacatattaatatttacctgcattccacattaaagggttcagtttatgacttgtgtcctgtcttgtagatacttaattaaacggtattaattttga

SEQ ID NO: 19993 - DNA, 2265 bp, Homo sapiens
  ENST00000569152
tcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctgggcctgctctccaacttccctgacatcatccatctacaaaaaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagat

SEQ ID NO: 19994 - DNA, 6835 bp, Homo sapiens
  ENST00000367619
agcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtgaaa

SEQ ID NO: 19995 - DNA, 870 bp, Homo sapiens
  ENST00000426956
gtattagcaagacatgaaaatctgtaggggcaccagaacctttaatcaagctcatgttttattgtaaaatattaggatgtagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcag

SEQ ID NO: 19996 - DNA, 6861 bp, Homo sapiens
  ENST00000540564
aataggatgctcagccggaggtggccctgcgcgtgacgcagcggtgctcggaggcagggggcgtaggggccgggctgtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtg

SEQ ID NO: 19997 - DNA, 6794 bp, Homo sapiens
  ENST00000539888
aataggatgctcagccggaggtggccctgcgcgtgacgcagcggtgctcggaggcagggggcgtaggggccgggctgtccggcgctttagcttagcaggcgacgttgcgggccctgggcgccaggagagcttcccggagtcgaccttcctgctggctgctctgtgaccgcttcccggctctgccctcttggccgaagtgcccgctgccgggcgcgggcctcaggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctcagaagtttgagaccagcctgggcaacatagcaaaaccttgtcactataaaaaatacaaaaattagccaggcgtggtggtgcacgcctgtagtctcagctactcagtcggctgaggtgggaagatggcttcaagccgggagatggaggcttcagtgacctgtgacctgtgatcacaccacttaattcctcaaaacatttatgtcccagttccctccatttcagagccatgggcaacagagcgagaccctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtg

SEQ ID NO: 19998 - DNA, 5245 bp, Homo sapiens
  ENST00000317357
agccacgcccgctcgagagccggggggctgtcctcgccccccccacctttcccctccctccgaccccctcccggccgcgctccctcccctcctcccgcgccggcccccggcccgcccccggctcggctcgcgggaggcgctgggcgccggggctggcgcgctctcccgggctcacacacagccgcgcacgcacgcccggggccgctctccgcgccggcccttgctccccgcgcccatgcggacggaccgagcgacggaagatggctgacgactccacggggccccgaggatgcggcccggcggcggcggcggcgggagcggcagcggcagcgagggcggcaggggcagcggcagcagcggcggcgttggctgcggcggcggcggcggcggcagcaggagccggagcgacggcggcggcatccccgagactctccgcactatccttacccgtgacagccactgacgtcctccgccgctagaagagaccccgcttctcggcgcctgccctccccctcgcggctcggtccggccccgccagcaccgctacctccgccagcctcgccaccatcagcaccacctccaccgccgccgccgccgccaccaccaccgccggcggcggcagcagccatttcatctccacagaaaccagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggctagagatgaagatggacatgctgaaaattttccccagcagcactatgctaaggaaactccaaggcttgccttcaagaataactgcgaactacttgtatgtgactggtgtaagcacataagacacacaaaagaatacctggattttggggacggggaaagaaggcttcagttctgcagtgcaaaatgtctcaatcaatacaaaatggacattttctacaaagagacccaggccaatcttccagctgggctgtgcagcacattacaccctcccatggaaaataaagcagaaggcaccggggtgcagctgctcactccagactcttggaatatcccgctaacagatgctcggaggaaggccccctccccggtggctacagctggccaaagccagggccctggcccgtcggcgtccaccaccgtctctccatctgacactgccaactgctctgtcactaaaatccccacgccagtgcccaagtccatccccatcagcgagactccaaatatccctcctgtctccgtccagccacctgctagcatcgggcctccccttggcgtcccgcctcggagccctcccatggtgatgaccaaccgcggcccggtgccgctgcccatcttcatggagcagcagatcatgcagcagatccgcccgcccttcatccgcgggcctccgcaccatgcctccaaccccaacagccccctgtccaaccccatgcttcccggcatcgggcccccgcccggtggccccagaaacctgggccccacttccagccccatgcaccggcccatgctatcgccccacatccaccccccgagcacccccaccatgcccgggaaccccccaggcctgctgcccccgccgcctccgggcgccccgctgccgagtcttcccttcccgccagtgagcatgatgccaaatggcccgatgccggtgccccagatgatgaatttcgggctgccgtcgcttgccccgctggtgccgcccccgaccctgctcgtgccgtaccccgtgatcgtgcccctaccggtgcccatccccatccccatccctatccctcacgtcagcgactccaagccccccaacgggttctccagcaacggggagaacttcattccgaacgcccctggcgactccgcggcggcgggcggcaagccaagcggacactccctgtccccccgggactccaagcagggctcgtccaagtccgcggactcgccccccggctgctcgggccaggccctgagcctggcgcccacgcccgccgagcatggccggagcgaggtggtggacctgacgcggcgcgccggcagccccccgggccccccgggcgcgggcggccagctcggcttcccaggcgtgctgcagggcccgcaggacggcgtcatcgacctgaccgtgggccaccgagcccggctgcacaacgtgatccaccgcgcgctgcacgcgcacgtcaaggcggagcgcgagccgagcgccgcggagcgcaggacctgcggcggctgcagggacggccactgcagcccgcccgccgccggcgacccaggcccgggcgccccggcgggccccgaggcggccgcggcctgcaacgtcatcgtgaacggcacgcgcggcgccgccgccgagggcgctaagagcgcggagccgcctcccgagcagccgccgccgccgccgccgcccgcgccccccaagaagctgctgtcgcctgaggaaccggcggtgagcgagctagagtcggtcaaggagaataactgtgcttccaactgccacctggacggggaggcggccaaaaagctgatgggcgaggaggccctggcggggggcgacaagtcagacccgaaccttaataaccccgcggacgaggaccatgcctatgctctgcggatgctgcccaagaccggctgcgtgatccagcctgtgccaaaacccgcggagaaggctgccatggcaccgtgcatcatctcctcgcccatgctcagcgccgggcctgaggacctggagccgccgctcaaaaggaggtgcctccgaattagaaatcagaataagtaaaaggaacgttcactcacagggtacgctcatggagagagggcgcagagcaaaccatgtcacgccatccaatgacaccagctggtcagctcaccaccccctctggctaaaactcaagcaaataaagccgcttcctgtcattaagcatctcagaggaagcagccctccctcgatggcctctagcccagagaagcccgcgcatcttggacccaccaagcaggcccagccttcctgctgccaccatctctgcttctccccagaggaacttagggatttcacccctggcttttaaaaaaaacgaaataccgacaagccacaaggaccaatgtaggtattctccccgccccatcttcaaggctcagcgactgaggctggaagatgatatggattggaacacaaaaaatctttttttaatctttttaaaaactgctgtggttttgctgctacactaagaattgtgatttgcattgtacggttttggacctatattgttcacgttttgatggcggagaggggtggtcctggaggcccaatgcttcagagtcatctctgtcctgcccgggatgcacttttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgataattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcacttacatgtgcttatttggcttttctc

SEQ ID NO: 19999 - DNA, 1535 bp, Homo sapiens
  ENST00000477448
ggggctggcgcgctctcccgggctcacacacagccgcgcacgcacgcccggggccgctctccgcgccggcccttgctccccgcgcccatgcggacggaccgagcgacggaagatggctgacgactccacggggccccgaggatgcggcccggcggcggcggcggcgggagcggcagcggcagcgagggcggcaggggcagcggcagcagcggcggcgttggctgcggcggcggcggcggcggcagcaggagccggagcgacggcggcggcatccccgagactctccgcactatccttacccgtgacagccactgacgtcctccgccgctagaagagaccccgcttctcggcgcctgccctccccctcgcggctcggtccggccccgccagcaccgctacctccgccagcctcgccaccatcagcaccacctccaccgccgccgccgccgccaccaccaccgccggcggcggcagcagccatttcatctccacagaaaccagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggtttatcctttgtctgtgtcattcagcttttcccattctaccaaggaggatgagcagaagatgactctgcataatttatggataatttctcctgtttttctgcctgtattctcccatgttatattgccattcattgtatctagagtgtaaaatttaaacattttagacttagaatgttgatccacaagattaatcctgacatgcttctgagactgatgtgaaaaaaattacaaagttaaatttctacaaaatttatgattataagatgtaggctgtattgatttttagtcttttcatttgatcttccttgcaaacttggttctgagtacttactgatacacttagattgtccaagaaatcaacttcagatgagagaacataaaatactttggaaatgagtttgtgtttctactattttcataaagatctagttcttttttttccccccccg

SEQ ID NO: 20000 - DNA, 572 bp, Homo sapiens
  ENST00000494935
gcggccgcggcctgcaacgtcatcgtgaacggcacgcgcggcgccgccgccgagggcgctaagagcgcggagccgcctcccgagcagccgccgccgccgccgccgcccgcgccccccaagaagctgctgtcgcctgaggaaccggcggtgagcgagctagagtcggtcaaggagaataactgtgcttccaactgccacctggacggggaggcggccaaaaagctgatgggcgaggaggccctggcggggggcgacaagtcagacccgaaccttaataaccccgcggacgaggaccatgcctatgctctgcggatgctgcccaagaccggctgcgtgatccagcctgtgccaaaacccgcggagaaggctgccatggcaccgtgcatcatctcctcgcccatgctcagcgccgggcctgaggacctggagccgccgctcaaaaggaggtgcctccgaattagaaatcagaataagtaaaaggtaatgggaggcttcgatagggaagagggtggcattgctaaagtgagtgacactgcacatctctgacctcatagacagactcctgcctaatg

SEQ ID NO: 20001 - DNA, 1550 bp, Homo sapiens
  ENST00000618129
cagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagatgagaaaactgaggcccagaaaagttgagcaacttgcctgaggttacacagatactgagtggcagagctgatatttgaacctatacattatgtctccttagcctatatccttaaccactggattatccaaaacactatggcagtatttcagtcagttaagtatttactgaatgttccttacattgtgctagacaatacagatgtatgtcatcatccttgactaccaagaacttaatagtactgttggcatatgatcaaaacatcattctagttttaccttggaatgtatgatataattttagttgcatatggaaggtgcatggtaggactacaagggcaattaaagtggagtagcaaaaagtctataggcagataatcaagaactgttatatttatacagttgaggggaaatggcacctgaaacttaatataggctagaagatagcaattgaaaactcaaattcaaagtgataaaaaaagatccaaaatgaaacctgaaaatgttagatactatgatatgggtcctgctttattgttctctttacaattaagggttcttaaaaatgtgtaaggcacattttagtgtgttctatcatttttaatgccagatgaaatgtataatttgaatggtagcatgaggtggtgaagactgccagagcaagaaccaggagacctgggttgctaatgccagctctgccatttattggccatgtaatcttgaataaggtagtttctctaagccttagtttccttgtctgcaaaatgatgtggttagcttacatgatctgttatttccctatatttataaaatccttattttgtgacttgtatggttagttgctctcctgattttatgatttgagagggtatgttttaatgtgctttaacaggtacttgttaattgaacagatataaagcaaactgcatatatgtatagttataacagccagaagtctgatgaaagatttatactgcttgggacaagttttaatgattgttaatttttactttgaacaaatagtgaatgaaataatagatttgacattttttaagataacaagtgctaggaaatatgaaatgtgagtaaataaaaaggttcatatgttattagaact

SEQ ID NO: 20002 - DNA, 2761 bp, Homo sapiens
  ENST00000340600
cttcccatagccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgga

SEQ ID NO: 20003 - DNA, 2072 bp, Homo sapiens
  ENST00000549206
acctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaa

SEQ ID NO: 20004 - DNA, 1065 bp, Homo sapiens
  ENST00000536696
caagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaa

SEQ ID NO: 20005 - DNA, 744 bp, Homo sapiens
  ENST00000548091
cgcagctcggagcgccggggaagagagagtccgaaccgcggctctgccccgcggcctagcgttgctgcctgctttctccagccccttctcggcgtctggaagtgcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagcccc

SEQ ID NO: 20006 - DNA, 2391 bp, Homo sapiens
  ENST00000549122
gcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaa

SEQ ID NO: 20007 - DNA, 3733 bp, Homo sapiens
  ENST00000548537
ggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaa

SEQ ID NO: 20008 - DNA, 984 bp, Homo sapiens
  ENST00000549887
gcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccat

SEQ ID NO: 20009 - DNA, 1716 bp, Homo sapiens
  ENST00000551556
gaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatc

SEQ ID NO: 20010 - DNA, 462 bp, Homo sapiens
  ENST00000547229
cgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccct

SEQ ID NO: 20011 - DNA, 719 bp, Homo sapiens
  ENST00000551883
actatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaa

SEQ ID NO: 20012 - DNA, 581 bp, Homo sapiens
  ENST00000549510
cagcaccatctctgcagcatctctgtaggctcaccattaacaaatgtaccggtgccatctggggactgcctttaccaacaagactaaaagattacttggaagaatataaattccagccagctgttttttatcctggttagaagaattttgtgttttcttttagctatggatctttgaacattaccctatgatcgaagagttttgagttgggtttttagatgttggttgtcatggagaaacaggaatctggtgtatgccagccatcatcatcatcatcataaccctttggatgaattttcattatcaagggatctggaaggctgtcttcgctctgcttcccagctaacaaacagatgtgttcccagaagatgatgggcatagggtgtgtttttgcaagtcatttttcccatttacgtagattattcttatttccaattgatcctcaatagataagagtgccattgagctttattttcatctgtcaggcaattaagaaaaaagtaaaggaaacaaaaaagctataatatactaaggaaattcttagattctttggtaaaattaaaagaatcttggtgcatgaa

SEQ ID NO: 20013 - DNA, 2881 bp, Homo sapiens
  ENST00000622746
gcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactgg

SEQ ID NO: 20014 - DNA, 966 bp, Homo sapiens
  ENST00000270142
gtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 20015 - DNA, 865 bp, Homo sapiens
  ENST00000389995
gtagtcgcggagacggggtgctggtttgcgtcgtagtctcctgcagcgtctggggtttccgttgcagtcctcggaaccaggacctcggcgtggcctagcgagttatggcgacgaaggccgaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 20016 - DNA, 586 bp, Homo sapiens
  ENST00000476106
gcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaagagacggcgtttcaccatgttggccaggatggtctcgatctgttgacgtcgtgatccacccgcctcggcctcccaaagtgctgggattacaggcgtgagccaccccgcccggccaccagtgctattcttaagacgcctctgaggaatcccttctccctggccattgagaatccatgcatgaacccaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctc

SEQ ID NO: 20017 - DNA, 1746 bp, Homo sapiens
  ENST00000470944
cagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggcaagggctgggacggaggcttgtttgcgaggccgctcccacccgctcgtccccccgcgcacctttgctaggagcgggtcgcccgccaggcctcggggccgccctggtccagcgcccggtcccggcccgtgccgcccggtcggtgccttcgcccccagcggtgcggtgcccaagtgctgagtcaccgggcgggcccgggcgcggggcgtgggaccgaggccgccgcggggctgggcctgcgcgtggcgggagcgcggggagggattgccgcgggccggggaggggcgggggcgggcgtgctgccctctgtggtccttgggccgccgccgcgggtctgtcgtggtgcctggagcggctgtgctcgtcccttgcttggccgtgttctcgttcctgagggtcccgcggacaccgagtggcgcagtgccaggcccagcccggggatggcgactgcgcctgggcccgcctggtgtcttcgcatccctctccgctttccggcttcagcgctctaggtcagggagtcttcgcttttgtacagctctaaggctaggaatggtttttatatttttaaaaggctttggaaaacaaaaatacgcaacagagaccgtttgtgtgacactttgcagggaagtttgctggcctctgttctaggtcatgattgggctgcaagggcagagaaggtagccttgaacagaggtccttttcctcctcctaagctccgggagccagaggtttaactgacccttttggggatttttgagggcagtgatcttaactttgggtgcacagttagcttatttgaagatcttactaaaaatacaccagagcccaacctccgaccaattacatcaaaacctgtcctagtgcagggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 20018 - DNA, 276 bp, Homo sapiens
  ENST00000598411
agaagggcaagatggagtctgcacagctgggccatgacccaggaacactatgaggagatgctggttctcctgtagctgctcctctttaggtgaccctggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggac

SEQ ID NO: 20019 - DNA, 567 bp, Homo sapiens
  ENST00000593742
gacccaggaacactatgaggagatgctggttctcctgtagctgctcctctttaggtgaccctggtgagtgatggtggtttggggactatgatggaagctatgacccacttcatttaaaatcatccctgaagattggccagaaccattctggattcatttctgagtgagacacatggcggctgccctattttcttccctaggccttggatctgaggcctctttttgaatcctgtcagccctgtcagcatttagaattcctaattatttttctaaaataaactctgagtcaagaggatctctcttccctctacatttccttctaacatcaattttctaaaattccaagagtagtctgtctcacctctgtcctcagattctgttttctacatgtggcaatggcaatgtctgtgcattttacacagctccttggagaacttccgcccatcttttctattagtttgttcattctgggagtatggaggaaaggggctgggccaagctggctttcagagtggggagagtacttctttctcatggtgaaattgcagggtgtgtgtgtgacggggt

SEQ ID NO: 20020 - DNA, 1526 bp, Homo sapiens
  ENST00000382120
ggggaggtctggcctgcttttcctccctgaactggcccaatgactggctccctcacgctgaccactcctctgggctggcctcctgcactcgcgctaacagcccaggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgctggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccctccactctgaggtctcaccttcgcctttgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcgggaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 20021 - DNA, 2824 bp, Homo sapiens
  ENST00000319471
cgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaa

SEQ ID NO: 20022 - DNA, 3049 bp, Homo sapiens
  ENST00000449407
gagctgagaggaccagccattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaa

SEQ ID NO: 20023 - DNA, 4622 bp, Homo sapiens
  ENST00000355634
ttttattacgtctctccttgtggattacgtagaactttggaaaattaaacattagacatcttcatagaaaatcatgtcactgatttttaaagccagctcaatttaacctgccactgattccctaaccagctcttctctgactgtatcccgagggaaaatgtattgaacgcagcagaaggttaaggcagaggagttcggctagaccgggtagcagccaatcagatggggagggtccaaggatctgatgcctccaggcgagcagcgccaagctgagctggttagtctccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagccaaccaatttgttggaaaatcagtcaaaatctaattttgatgttctgcaagttccctgggggccatgaagcacctgacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggc

SEQ ID NO: 20024 - DNA, 3043 bp, Homo sapiens
  ENST00000393528
cattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaactgatcgcataaatccagatgacatagatttagaaaatgagccctggtataaattcttttcagaactggagtttggacgcccgcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgagg

SEQ ID NO: 20025 - DNA, 420 bp, Homo sapiens
  ENST00000478461
tcatgaaggtgtcaagatgtttttaaacacattcccttgtcctgtttaaggtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccg

SEQ ID NO: 20026 - DNA, 2011 bp, Homo sapiens
  ENST00000319454
taaaaggccactgactcctacttcctctgtatagagcaactgttgaactcagctgcctgtaggaaaactgaagactttaataacaaactctccaaggtgaaaatgaacacagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgt

SEQ ID NO: 20027 - DNA, 2096 bp, Homo sapiens
  ENST00000498125
gatttgggagttgggaggtgagatgattggagtgaagagagttaatgtcatggaaaggaaaagctgtctgaagaaaaatacacattttaatgtccctcttcagccgtgcctgctgagagctctcctgggatgataagtgaaagtgtttggatttttttttaagttttaaaactctgccaaagcattgctcagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagttggcttccagtgaaccagcccctcctcccacccacaaagtctcacctggctcagataaaggagctctccagggaactggccagggctggttgtccctgacagcctcatgtctaccagcaaaccctttggccccaacaccacctcgtttcctggacaacttcttgggtgaattggagaagcttggtgctttaaccttgtcagctgaccaagccaaaccaaccatcctagaggacgccatcctggaaattaaggaggaacctgctgtcctcctcccattgtccccagcgactgcacctgccgaatcaccttccactcacgcgggtgtggcctcgg

SEQ ID NO: 20028 - DNA, 512 bp, Homo sapiens
  ENST00000480146
gtgttgatcttgagaattattgctgtacatcacaaaaagaccatgtcaacgtgtctcttccagggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaaggtagcccagctggttttttgtttgtttgtttttgtttgtttgttcttcagtgggtttgaaaaggctgtatattttcaaaactaaaataggttatctttttctttagacatttttatgtttaccctattttctacaaaggactctttaaggcagcccagagtcacggttccctgctggtccctgtgtccttttagaggagttcccc

SEQ ID NO: 20029 - DNA, 873 bp, Homo sapiens
  ENST00000451974
caaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccacctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaa

SEQ ID NO: 20030 - DNA, 871 bp, Homo sapiens
  ENST00000438278
ctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgatttt

SEQ ID NO: 20031 - DNA, 294 bp, Homo sapiens
  ENST00000487184
tggacctcccaggatcaagcaccactcttacaaagtctttcactagctcttctccttcttccccatcaagagcaaaagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactg

SEQ ID NO: 20032 - DNA, 759 bp, Homo sapiens
  ENST00000445625
agcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaag

SEQ ID NO: 20033 - DNA, 723 bp, Homo sapiens
  ENST00000487836
agcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttct

SEQ ID NO: 20034 - DNA, 556 bp, Homo sapiens
  ENST00000495932
ggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggac

SEQ ID NO: 20035 - DNA, 593 bp, Homo sapiens
  ENST00000490562
agcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgag

SEQ ID NO: 20036 - DNA, 911 bp, Homo sapiens
  ENST00000492104
tttgggagttgggaggtgagatgattggagtgaagagagttaatgtcatggaaaggaaaagctgtctgaagaaaaatacacattttaatgtccctcttcagccgtgcctgctgagagctctcctgggatgataagtgaaagtgtttggatttttttttaagttttaaaactctgccaaagcattgctcagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccg

SEQ ID NO: 20037 - DNA, 1034 bp, Homo sapiens
  ENST00000490779
agcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatcagtgtcctcaggattttctttgaaactccacagttcctctgcatctccttccaagcctacttctaggaaaacatttgcaatcaattgcaatttactctcatttttgctttaaaagaattttaggtgtcagtgaacaggaaaaagagagttttctttgtggagctccttcaagagtctccaagaaatcacactcatatataatccaaggccagccctgtggtttaattggaaactctagccttgccacacccaacatgagt

SEQ ID NO: 20038 - DNA, 780 bp, Homo sapiens
  ENST00000492810
agtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatc

SEQ ID NO: 20039 - DNA, 571 bp, Homo sapiens
  ENST00000476311
gagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagttaccaagcctcaagcttcctgattgattgtcattctaatggatcaagattatatttcactttgcaggattttttccaattatttaat

SEQ ID NO: 20040 - DNA, 1031 bp, Homo sapiens
  ENST00000466289
ggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagtaagcacttgtcattaaacagaatatgccagctcgctgggctcccagggctccccaataaacctgaatttcagacccattagcaatttttgtcacaaaggtaatcacttagaaatcatgtttattttgtataatgatttgtacatctcatctcagaattgaaagatacatgttctaatatattgtctttactgaccaaatacaagtgtatgtgtgtgtgtatgtgtgtgtatttatatatatatatatacacacacacatgcaggtgtatatacatacacatatatacacatgtgtatgcacacacatatatatatttatatgcaagattcatttgcatgtaactctaactgtgcctaatcattaatcagagtttaacttttaaaaaagttcataagtgcaatacttaattgctatcatagcttgctaatgagaaaaatcattaattaatctccccaatatacatggacccaggcagttccatcccttgtttt

SEQ ID NO: 20041 - DNA, 658 bp, Homo sapiens
  ENST00000485380
gagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagtaagcacttgtcattaaacagaatatgccagctcgctgggctcccagggctccccaataaacctgaatttcagacccattagcaatttttgtcacaaaggtaatcacttagaaatcatgtttattttgtataatgatttgtacatctcatctcagaattgaaagatacatgttctaatatattgtctttactgaccaaatacaagtgtatgtgtgtgtg

SEQ ID NO: 20042 - DNA, 1790 bp, Homo sapiens
  ENST00000470685
gagctgagaggaccagccattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagtaagcacttgtcattaaacagaatatgccagctcgctgggctcccagggc

SEQ ID NO: 20043 - DNA, 538 bp, Homo sapiens
  ENST00000494140
gacttctcatgaatgttatgctgtgtgtggcagagaaagaaagctgttgatgggagagaattacacaatctgtttttccatttgaatgaaacatcatgaacattgcgattttgttaaatgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccag

SEQ ID NO: 20044 - DNA, 546 bp, Homo sapiens
  ENST00000445343
agcacaacaatcatttgttgagagcctactcaagactctgtacttgtccgtgacagtcactgggagcatagcctttctccaatgacatcgccctgaacatccactctaaaaatgcagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacga

SEQ ID NO: 20045 - DNA, 565 bp, Homo sapiens
  ENST00000439914
aacagattgtgggctcccagggcatatgtctgcacgctgaggccgaggcggagaaggggcttcctgagcgtcccagtacactgacagagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccgg

SEQ ID NO: 20046 - DNA, 760 bp, Homo sapiens
  ENST00000444771
tggcgatctgggcaaggcattttcatccctttgcagacaaccccggctgctgttaatgctgaaaatagctcaaatgctctcagaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacg

SEQ ID NO: 20047 - DNA, 499 bp, Homo sapiens
  ENST00000430503
gactcctacttcctctgtatagagcaactgttgaactcagctgcctagcgagaataggacagactcgtataccattctgatctgggtgcatttcttcagaaggaaaactgaagactttaataacaaactctccaaggtgaaaatgaacacagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattaccca

SEQ ID NO: 20048 - DNA, 567 bp, Homo sapiens
  ENST00000450341
gtaaaaggccactgactcctacttcctctgtatagagcaactgttgaactcagctgcctgtagagcgagaataggacagactcgtataccattctgatctgggtgcatttcttcagaaggtacgctgtcctcacgggaaaccgcccgccactgcctgggtttggggctgatgaggccaggaagaaacttaatgcgtgcactctaacaaaaagatttcccaggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattaccca

SEQ ID NO: 20049 - DNA, 575 bp, Homo sapiens
  ENST00000445115
attctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaa

SEQ ID NO: 20050 - DNA, 573 bp, Homo sapiens
  ENST00000457247
agaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggtaaacacggtgttccagaatacagcaggagcatctgggcatttttgtggctggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagagg

SEQ ID NO: 20051 - DNA, 574 bp, Homo sapiens
  ENST00000456596
tttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccg

SEQ ID NO: 20052 - DNA, 629 bp, Homo sapiens
  ENST00000425679
aaatgctctcagaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatcc

SEQ ID NO: 20053 - DNA, 549 bp, Homo sapiens
  ENST00000439049
aagcagataggtttcagagataaagagtgaaaccaaaaacaccgcacacctcatccaaatctgcgctcatacttgcagcaaatgtttgctgtcagttgcttcataataacagcacagaccccgaattgcaggaggaattgcctggtagaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctat

SEQ ID NO: 20054 - DNA, 594 bp, Homo sapiens
  ENST00000451958
agattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatg

SEQ ID NO: 20055 - DNA, 611 bp, Homo sapiens
  ENST00000444781
gtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatat

SEQ ID NO: 20056 - DNA, 590 bp, Homo sapiens
  ENST00000414724
tttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatcc

SEQ ID NO: 20057 - DNA, 835 bp, Homo sapiens
  ENST00000419063
gtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatat

SEQ ID NO: 20058 - DNA, 842 bp, Homo sapiens
  ENST00000393523
ggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccc

SEQ ID NO: 20059 - DNA, 572 bp, Homo sapiens
  ENST00000420158
attgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccg

SEQ ID NO: 20060 - DNA, 572 bp, Homo sapiens
  ENST00000421639
agttgtaaagcaaacagtgtaggtattggaagccgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcaaaaggttttagaagcgttcgaccaaacctacaagataaaagatcaccaactcagagccagataacagtgaatggaaactcaggaggtgccgtg

SEQ ID NO: 20061 - DNA, 715 bp, Homo sapiens
  ENST00000493709
aattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccg

SEQ ID NO: 20062 - DNA, 553 bp, Homo sapiens
  ENST00000457934
aaatgctctcagaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggt

SEQ ID NO: 20063 - DNA, 562 bp, Homo sapiens
  ENST00000431902
accacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcag

SEQ ID NO: 20064 - DNA, 487 bp, Homo sapiens
  ENST00000435480
agaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactca

SEQ ID NO: 20065 - DNA, 626 bp, Homo sapiens
  ENST00000415274
gatgcctccaggcgagcagcgccaagctgagctggttagtctccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactca

SEQ ID NO: 20066 - DNA, 582 bp, Homo sapiens
  ENST00000432655
gtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagat

SEQ ID NO: 20067 - DNA, 582 bp, Homo sapiens
  ENST00000451701
gattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcaaaaggttttagaagcgttcgaccaaacctacaagataaaagatcaccaactcagcttggaaatcagaacttacctgccagtgtgttggaggtaaatgcttcacagacacacagacaaaccacaccagaagcttctcctccgtgccctccttccgtggtacctttgaaccgagccactttctcaccaggcagtggcaccagctcagcatcactcagccttccg

SEQ ID NO: 20068 - DNA, 525 bp, Homo sapiens
  ENST00000428330
ctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagcttggaaatcagaacttacctgccagtgtgttggaggtaaatgcttcacagacacacagacaaaccacaccagaagcttctcctccgtgccct

SEQ ID NO: 20069 - DNA, 574 bp, Homo sapiens
  ENST00000421420
ctttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcaggcaccccctccaccagaaagaaaagagagctttcatagctctttgataaccagtcacacaaagggtgtcattttagaccagttagtaactaacacacaaattccctccagtacagagtactttgctaacaaaaaacctcttcagggaactatgtattccaatgaagattcgagacagacaattgtatattctgaagaatctaacacaaccatgtcatatacacaaaaaatcactaatccactaccagcagcttccagcacggatcctgcaccattcgctaacatcaacacc

SEQ ID NO: 20070 - DNA, 563 bp, Homo sapiens
  ENST00000464975
aagaatagactgacaacagatactgctaccagagggctctcaactatttcttaagaccccctaggaaatatcagaagaaaagcctccttctcaataaagcataagtaggacatctcgttttcagtgaatcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcaggcaccccctccaccagaaagaaaagagagctttcatagctctttgataaccagtcacacaaagggtgtcattttagaccagttagtaactaacacacaaattccctccagtacagagtactttgctaacaaaaaacctc

SEQ ID NO: 20071 - DNA, 540 bp, Homo sapiens
  ENST00000464819
agttgtaaagcaaacagtgtaggtattggaagccgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcaggcaccccctccaccagaaagaaaagagagctttcatagctctttgataaccagtcacacaaagggtgtcattttagaccag

SEQ ID NO: 20072 - DNA, 594 bp, Homo sapiens
  ENST00000478249
aagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcaaaaggttttagaagcgttcgaccaaacctacaagataaaagatcaccaactcaggcaccccctccaccagaaagaaaagagagctttcatagctctttgataaccagtcacacaaagggtgtcatttt

SEQ ID NO: 20073 - DNA, 571 bp, Homo sapiens
  ENST00000452351
agcagggatgaatgtcctgacagcgtgtgtccactgtgcatgtgcttccacttgtcagcatgggcgaagcccaagtatgatgtgtagacaagaccaccgcttctctctgctccattcctgcacaagccacacacagcagacttgtatttctgtcaagggctccggttttccatcatctattttttatagcactgatactcaaccagttgcagcaaatgaagggtattatttctggtttgagggcatcgcgatgctgatttgccattcctaggaagcaaactcaccgtgttgggctctcattttaccatgggagacccggctccacaaaaccggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcag

SEQ ID NO: 20074 - DNA, 534 bp, Homo sapiens
  ENST00000429056
ctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactca

SEQ ID NO: 20075 - DNA, 567 bp, Homo sapiens
  ENST00000463104
tgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcacc

SEQ ID NO: 20076 - DNA, 543 bp, Homo sapiens
  ENST00000456060
agatagaatatgactggtgatagagtcctgaaaaagaagaaaagcctgggggttctgcagaagatttacgttgttcatggcattaatcatggtagattcccagaggaggtgaaatgttatggacgggtggaatgtgatccattttactgaggaagtaaaactattcttgccttgaagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaaggaaaactgaagactttaataacaaactctccaaggtgaaaatgaacacagatagcggtgggtgtgctcgcaaacgtgccgccatgt

SEQ ID NO: 20077 - DNA, 595 bp, Homo sapiens
  ENST00000476878
tccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtaggtgcatttcctgtccatttcagaagctaattatgaaatggccacacaactggatgtttctgtttataaaatagtgttccttggaggggcttgcaacatctaaatatcttatgtcagaataaaagccactgagatccaaagaagtggactaaacttgacaatatctgaaagtcttctgctggaccaggaacccctacagtggacagtgtgcttcctgcttttccacgcagttcgacaggaaaaccatcccaaagtgaacaaaaatggaagcctgcgaagttca

SEQ ID NO: 20078 - DNA, 4964 bp, Homo sapiens
  ENST00000462661
agagctgagaggaccagccattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggtaagattttttattctggaattatttaattgttttctggtatgttcataactaatgtctttaaaataacttacttatagtgaaaataataaggggagttgtgaacaattttcaggtaaacacggtgttccagaatacagcaggagcatctgggcatttttgtggctgtaagttttaaactttgcttaaagctctcataatagtgacctgcagtacacgcttgactatgactaagccatggatcagaggtctaattaagcctgattgccagagcaatgagaggatgtttcagacatcatatttttgttgtttagactgctttatttttaactttccaggggcattaaaaaaaaaaaaagaggaaaaagatgcaaccatccacctgagtaaagataatatatataagtaattgttctttaagggcaatgagcgagccgtattgtataatgttctcctttcatcactgtttcgttcattgctcgtgtggaattagagtggttgatttgggggaatctgggggttttgtttttgttattgttgttttgtatgttcctagcacattttaggggacagtgttgaggattccttactaagctgactgtcttttgctgggtacatctgctggcaggtttctctaacgtgacaatgtgatacttcgggtcagtttctgtggctcccctctccccctcgttacgcttgcacttgacattttgcgaagtactttgatctgtggactttaacttcaaacacagcatttactttgattgtggctatttactatgctcagtaaaaagtctccttttttttccttttggtttaatgctttcatagcatttcctttaaacaatttattggagctttagttttcctcactgatctgtcttagatttcacttctagagggacccccaattgtaagaaaagtgttctctggtaaagttctccccaacacagacttcaggacagttcatggcccctgtctggcagatgtgtaagagcaagcagcaaatgagagtgcacagagccccgcgctggctgccctgctgcctcagaatctccgtgtgccttggggcccaactggtgctttttaaaaacatggatgctgaaatctttggagttcagaaatacttttttttcagaaaagtttattggtatcacagagcacatatcaaaggaaagcatgcattttaaccacataaggatcgtctgagtaacaaaaacgggaagaaataacaaagaaaaagaaaattagaatcaaaagaaaactggaaaaaaaaaaaaaaccttagtagccagaagtctgttttacgagtgaaacttctgctgtgtaagggataagggatttcttaaaaatgtatttcctaaaatgggcaaaatgtagcacttactagccattcaatcagctttggaatattctcttcattgtgaagaaagcacaggtgtgtgtgacatttgttcccttcttctttcccaccccaagcacaaggtattttcacagtcctcagccaaatacagagtttgacgttccctggcaaacggtccctgcgtgttctgttgaaggttaggagtagaatgagcctaatcctgtcaggagactgtttaagtcccagtcaaggacgctagctcctcagcgctgacgcagtctgccccgtcctctgcaccttgctaagaaggacaaacgcaagtggccacaggacaaatctccaaaggggcggagctgtggagaaagctacggcagagatctccctggattaggagcagatgcaatcgaatctccagaacttggatttatagtagaaaaacctagagatgttcagtctaatctttaagtttcccaaacctgggcatttcattgccacttttccccttcaaatctacattataagaagcatgtcaatcatcgcatttatgtgtatggttaccattttaaatcctcccgttattttgagcctgggctttgttggggggatggggtgcgtctagctagaatactcactctcccttagtactgggaagccttggtctgcagggctgagtgcaaatatattgctagaggtgatagtccagcggcaaaattaaatggcaccaggatgaaatctttttggagaatggtaggtgatcattccattcccaggcaagccattttccccctgttttgttttgttttttttttctttctgtttctcttcacccctgaattttacgttgaaactttggattgtttgaatgtgaaacttcaggtgaaagctagccaaagccaccgagtttcacccagcttccacatgaaagaagtattctacccagccttgcacgaaacttggcctgtgttgccaaaggtttcatgaatgtcagtgagcctggatttgaaacataacccaaggccaggtgacttctggtgactttgaggctttattgtattagtatagaatctgctgaacagggacagtcctatttccgcatcttctactatagtttcatgagggcacacgttttcccccagtaaactcccatttatctcatgatgtttgaaagccaggttcaatcctaatgtgaatgtttgtagccgtgggatcgaagcactggcagatagaggtctgcgttttaaattccagcagcctggccctcagtggtgtgaacatgttggtataattcagctgaaggaaggaagtcccgggagagccgtggaatgcctttctttgcttaaatatacctctgtgctcgtgaggaacaaacagtaacattttgtccaggtctatccgcttgacagtatgccttttgttccctctccaaaggtggtgtcaaatatattggtggaaaaataataaacttccagatattttttttccgcctgctcaactgatatactccaagggaacattgcaagcattgagaagttcagtactgtggctgggaatgtaaggtatactgagaataaaggagctctcagtgaaggcaatgtccctcagaaaagcatggcgacccagagttgatgtgggtgtgaacggtcagatggtccccggttgggaaggggtgtgtgtgtgttttctgggtcggggtagtagcgagcagagaggaaaagggagatttgtaagctttgttcagcaaatctgtcacatcgaaaacaaaaataatcaagcccaggatctgaaaacattcctttcttttgtagatcatataaatttgtgttggctgaatattgaatttttttgtattatttttctcattagagacaccaagcattaggattccaggcatagtaaataatctccaatgaaaatatgacccattgggaaacataaaatcattgcagataactcccatgagtcagtcccaggaaggtcctcatggttctctggcagttatgaaatgctaagccacccaggacactaagatctgacttgtccttttcttagttgggagatttctaaactcatgtgaagaattttcataaaaatgaatgtgtggcctcactaaagatttaggctatctttggtgagatacatagatatagatttattataaaattaaattgccatcaaatttcattttgaaatttcatagtcacttatatattcaataaaacagactttcattaaagatgtggtttgcattttagcaggtgacatgcagtggatgccctagtagagaaagcactggaaaagctagcaataacacaatttggaagtgccatatgtagaagctgctttttagcactggcttcaccagtcatagtgtagcatttatcagcatatgtgatttgatagccccagactggtacagtgagcagaggaaaggaagatgttcaaatggaggttctagagaaaatcattcagaaccatcccacaaggaagctctcactaaccatatcaaggtataaggagttcagtagttttaagacattcatcatccataacaaaacagaaaaaggggaaggataggcttggcgtggtggctcacgcctataaccccagcacgttgggaggccgaggcaggtggatcacttgagatcaggagttcaagaccagcctgaccaaaatggtgaaaccccatctctactaaaaaaaaaaaaaaaatgcaaaattagccaggcatggtggtgcacacctataatcccagctacttgggaggctgaagtgggagaatagcttgaacctgggaggcggagggtgcagtgagccaagatcccaccattgcactccagcctgggcaacaagagtgaaactctgtctcaaaaaaaaaaaaaaaaaaa

SEQ ID NO: 20079 - DNA, 1575 bp, Homo sapiens
  ENST00000469627
accacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtaggtaagattttttattctggaattatttaattgttttctggtatgttcataactaatgtctttaaaataacttacttatagtgaaaataataaggggagttgtgaacaattttcaggtaaacacggtgttccagaatacagcaggagcatctgggcatttttgtggctgtaagttttaaactttgcttaaagctctcataatagtgacctgcagtacacgcttgactatgactaagccatggatcagaggtctaattaagcctgattgccagagcaatgagaggatgtttcagacatcatatttttgttgtttagactgctttatttttaactttccaggggcattaaaaaaaaaaaaagaggaaaaagatgcaaccatccacctgagtaaagataatatatataagtaattgttctttaagggcaatgagcgagccgtattgtataatgttctcctttcatcactgtttcgttcattgctcgtgtggaattagagtggttgatttgggggaatctgggggttttgtttttgttattgttgttttgtatgttcctagcacattttaggggacagtgttgaggattccttactaagctgactgtcttttgctgggtacatctgctggcaggtttctctaacgtgacaatgtgatacttcgggtcagtttctgtggctcccctctccccctcgttacgcttgcacttgacattttgcgaagtactttgatctgtggactttaacttcaaacacagcatttactttgattgtggctatttactatgctcagtaaaaagtctccttttttttccttttggtttaatgctttcatagcatttcctttaaacaatttattggagctttagttttcctcactgatctgtcttagatttcacttctagagggacccccaattgtaagaaaagtgttctctggtaaagttctccccaacacagacttcaggacagttcatggcccctgtctggcagatgtgtaagagcaagcagcaaatgagagtgcacagagccccgcgctggctgccctgctgcctcagaatctccgtgtgccttggggcccaactggtgctttttaaaaacatggatgctgaaatctttggagttcagaaatacttttttttcagaaaagtttattggtatcacagagcacatatcaaaggaaagcatgcattttaaccacataaggatcgtctgagtaacaaaaacgggaagaaataacaaagaaaaagaaaattagaatcaaaagaaaactggaaaaaaaaaaaaaa

SEQ ID NO: 20080 - DNA, 598 bp, Homo sapiens
  ENST00000488562
agacgaatagacccacagatgattcaaacactgttgtactttaatggttactgcaaaataccacagttcacgatgattctacagcgatactctagaactgctgtaacgttcgagtagacatgagatcactgggtggattgtgtttttaccaacatatgaaactgtaattatccatgagcaccgtactgcctttggagacactgctgggactgtgactcagacctcccttgagacaactggtcattaggagtcacagtgatgtggaatcaactttgtctttctgaaaagctggagatattcatcatagcctggactgcctgggatctacatgttttctccgtgttgtaatgatgtgaaacactttattagcagaggaagacatttttaggagaagcattttgaatcagaaggcttaagaagaattctgcttttctcccaaccaatttgttggaaaatcagtcaaaatctaattttgatgttctgcaagttccctgggggccatgaagcacctgacacttggattggacttaatcttaaacctctggagttcaagaccttttaaaaagggctaaataaacaatctctacatgtaaaaggc

SEQ ID NO: 20081 - DNA, 5529 bp, Homo sapiens
  ENST00000418609
gatttgggagttgggaggtgagatgattggagtgaagagagttaatgtcatggaaaggaaaagctgtctgaagaaaaatacacattttaatgtccctcttcagccgtgcctgctgagagctctcctgggatgataagtgaaagtgtttggatttttttttaagttttaaaactctgccaaagcattgctcagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 20082 - DNA, 4356 bp, Homo sapiens
  ENST00000448662
aagcagataggtttcagagataaagagtgaaaccaaaaacaccgcacacctcatccaaatctgcgctcatacttgcagcaaatgtttgctgtcagttgcttcataataacagcacagaccccgaattgcaggaggaattgcctggtagaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccacctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 20083 - DNA, 3381 bp, Homo sapiens
  ENST00000437304
agctttcaaaaatagcatagttgatgaaactggaaatttaggtgcgggctcttttaagaaatcatttgtcttcagtcttaagaatagactgacaacagatactgctaccagagggctctcaactatttcttaagaccccctaggaaatatcagaagaaaagcctccttctcaataaagcataagtaggacatctcgttttcagtgaatcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcaaaaggttttagaagcgttcgaccaaacctacaagataaaagatcaccaactcaggcaccccctccaccagaaagaaaagagagctttcatagctctttgataaccagtcacacaaagggtgtcattttagaccagttagtaactaacacacaaattccctccagtacagagtactttgctaacaaaaaacctcttcagggaactatgtattccaatgaagattcgagacagacaattgtatattctgaagaatctaacacaaccatgtcatatacacaaaaaatcactaatccactaccagcagcttccagcacggatcctgcaccattcgctaacatcaacaccccagttctacaagaggactacaggcaagattctcaaactcggaggatttctaccttgaaactaacccataaccaggatctaggaagtagcagccccattagtactccacagttctccaaatctgtcgaagtaccgtcatttctcaaaaggccccgctcactgacccctaatccagtgcctgagacacacacagcatctctttccattcagatagctcccctttcaggacaggatcttgaaagccacaaacagctacctgagctttctccagagactgcaaagatacctcttcagcaagagagacaaaaatctgcagttgcagcggcctctcagtcctcagactgcagagtgagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaa

SEQ ID NO: 20084 - DNA, 5996 bp, Homo sapiens
  ENST00000284776
tccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 20085 - DNA, 718 bp, Homo sapiens
  ENST00000522037
aggcagaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacggttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccga

SEQ ID NO: 20086 - DNA, 568 bp, Homo sapiens
  ENST00000523941
agaaaagatggcagagggagggtgaacccagggcccatctgtgggtatgggctccaatttcctaaattgtttgtggttataaccatggcttccaccttgtctggcaccgggtccacatcttttctgagacctgctagaaggtcagagccctagagaataagagaagcttgctgctggtgagggggtatggccaggattcctggagtcggaagagcttcagcttcaccatcttgggagaagaaggaagaaagtgaaagcgatgtggtccttcttagtcccaaggaccctgacagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccgg
